United States Patent 10,696,975 (GENES AND USES FOR PLANT ENHANCEMENT) - sequence listing, part 21

SEQ ID NO: 94678 - protein, 692 aa, artificial
  consensus sequence
  misc_feature (1)..(65): Xaa can be any naturally occurring amino acid
  misc_feature (67)..(67): Xaa can be any naturally occurring amino acid
  misc_feature (72)..(74): Xaa can be any naturally occurring amino acid
  misc_feature (76)..(103): Xaa can be any naturally occurring amino acid
  misc_feature (105)..(110): Xaa can be any naturally occurring amino acid
  misc_feature (113)..(114): Xaa can be any naturally occurring amino acid
  misc_feature (116)..(117): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (129)..(129): Xaa can be any naturally occurring amino acid
  misc_feature (133)..(135): Xaa can be any naturally occurring amino acid
  misc_feature (149)..(149): Xaa can be any naturally occurring amino acid
  misc_feature (158)..(158): Xaa can be any naturally occurring amino acid
  misc_feature (161)..(161): Xaa can be any naturally occurring amino acid
  misc_feature (163)..(164): Xaa can be any naturally occurring amino acid
  misc_feature (166)..(233): Xaa can be any naturally occurring amino acid
  misc_feature (236)..(237): Xaa can be any naturally occurring amino acid
  misc_feature (239)..(240): Xaa can be any naturally occurring amino acid
  misc_feature (243)..(247): Xaa can be any naturally occurring amino acid
  misc_feature (249)..(265): Xaa can be any naturally occurring amino acid
  misc_feature (267)..(271): Xaa can be any naturally occurring amino acid
  misc_feature (273)..(276): Xaa can be any naturally occurring amino acid
  misc_feature (278)..(279): Xaa can be any naturally occurring amino acid
  misc_feature (281)..(286): Xaa can be any naturally occurring amino acid
  misc_feature (288)..(298): Xaa can be any naturally occurring amino acid
  misc_feature (300)..(331): Xaa can be any naturally occurring amino acid
  misc_feature (333)..(334): Xaa can be any naturally occurring amino acid
  misc_feature (336)..(397): Xaa can be any naturally occurring amino acid
  misc_feature (399)..(401): Xaa can be any naturally occurring amino acid
  misc_feature (403)..(433): Xaa can be any naturally occurring amino acid
  misc_feature (435)..(438): Xaa can be any naturally occurring amino acid
  misc_feature (440)..(473): Xaa can be any naturally occurring amino acid
  misc_feature (475)..(574): Xaa can be any naturally occurring amino acid
  misc_feature (576)..(692): Xaa can be any naturally occurring amino acid
XXXXXXXXXXXXXXXXXXXXXXXXXXXXXXXXXXXXXXXXXXXXXXXXXXXXXXXXXXXXXXXXXGXLAWAXXXVXXXXXXXXXXXXXXXXXXXXXXXXXXXXQXXXXXXLDXXAXXLXRXIXDLRLRXPPPXXXQRLPHLHAHSLASXAALALQLNXHSXTXXQXXXXXXXXXXXXXXXXXXXXXXXXXXXXXXXXXXXXXXXXXXXXXXXXXXXXXXXXXXXXXXXXXXXXREXXLXXENXXXXXAXXXXXXXXXXXXXXXXXLXXXXXEXXXXEXXLXXXXXXAXXXXXXXXXXXSXXXXXXXXXXXXXXXXXXXXXXXXXXXXXXXXLXXKXXXXXXXXXXXXXXXXXXXXXXXXXXXXXXXXXXXXXXXXXXXXXXXXXXXXXXXXXXXXXXVXXXEXXXXXXXXXXXXXXXXXXXXXXXXXXXXXXXEXXXXKXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94679 - protein, 585 aa, artificial
  consensus sequence
  misc_feature (1)..(215): Xaa can be any naturally occurring amino acid
  misc_feature (217)..(217): Xaa can be any naturally occurring amino acid
  misc_feature (219)..(220): Xaa can be any naturally occurring amino acid
  misc_feature (222)..(226): Xaa can be any naturally occurring amino acid
  misc_feature (228)..(231): Xaa can be any naturally occurring amino acid
  misc_feature (234)..(235): Xaa can be any naturally occurring amino acid
  misc_feature (237)..(239): Xaa can be any naturally occurring amino acid
  misc_feature (241)..(242): Xaa can be any naturally occurring amino acid
  misc_feature (246)..(287): Xaa can be any naturally occurring amino acid
  misc_feature (289)..(290): Xaa can be any naturally occurring amino acid
  misc_feature (295)..(295): Xaa can be any naturally occurring amino acid
  misc_feature (297)..(297): Xaa can be any naturally occurring amino acid
  misc_feature (299)..(300): Xaa can be any naturally occurring amino acid
  misc_feature (302)..(302): Xaa can be any naturally occurring amino acid
  misc_feature (304)..(304): Xaa can be any naturally occurring amino acid
  misc_feature (307)..(307): Xaa can be any naturally occurring amino acid
  misc_feature (311)..(312): Xaa can be any naturally occurring amino acid
  misc_feature (314)..(314): Xaa can be any naturally occurring amino acid
  misc_feature (316)..(316): Xaa can be any naturally occurring amino acid
  misc_feature (320)..(321): Xaa can be any naturally occurring amino acid
  misc_feature (328)..(328): Xaa can be any naturally occurring amino acid
  misc_feature (331)..(340): Xaa can be any naturally occurring amino acid
  misc_feature (342)..(342): Xaa can be any naturally occurring amino acid
  misc_feature (347)..(347): Xaa can be any naturally occurring amino acid
  misc_feature (349)..(479): Xaa can be any naturally occurring amino acid
  misc_feature (481)..(481): Xaa can be any naturally occurring amino acid
  misc_feature (483)..(483): Xaa can be any naturally occurring amino acid
  misc_feature (485)..(522): Xaa can be any naturally occurring amino acid
  misc_feature (524)..(585): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXLXXAXXXXXRXXXXWTXXGXXXRXXLVIXXXXXXXXXXXXXXXXXXXXXXXXXXXXXXXXXXXXXXXXXXLXXLTGLXLXFXXFXLXATXNAIXXSXLXSLAXXAGGFLAXFFXXXXXXXXXXAXYIGAXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXFXIXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXX

SEQ ID NO: 94680 - protein, 200 aa, artificial
  consensus sequence
  misc_feature (1)..(129): Xaa can be any naturally occurring amino acid
  misc_feature (131)..(131): Xaa can be any naturally occurring amino acid
  misc_feature (135)..(137): Xaa can be any naturally occurring amino acid
  misc_feature (140)..(140): Xaa can be any naturally occurring amino acid
  misc_feature (144)..(145): Xaa can be any naturally occurring amino acid
  misc_feature (147)..(147): Xaa can be any naturally occurring amino acid
  misc_feature (150)..(152): Xaa can be any naturally occurring amino acid
  misc_feature (154)..(154): Xaa can be any naturally occurring amino acid
  misc_feature (157)..(158): Xaa can be any naturally occurring amino acid
  misc_feature (161)..(162): Xaa can be any naturally occurring amino acid
  misc_feature (169)..(170): Xaa can be any naturally occurring amino acid
  misc_feature (173)..(174): Xaa can be any naturally occurring amino acid
  misc_feature (177)..(177): Xaa can be any naturally occurring amino acid
  misc_feature (179)..(179): Xaa can be any naturally occurring amino acid
  misc_feature (181)..(181): Xaa can be any naturally occurring amino acid
  misc_feature (183)..(183): Xaa can be any naturally occurring amino acid
  misc_feature (185)..(185): Xaa can be any naturally occurring amino acid
  misc_feature (188)..(190): Xaa can be any naturally occurring amino acid
  misc_feature (192)..(193): Xaa can be any naturally occurring amino acid
  misc_feature (195)..(195): Xaa can be any naturally occurring amino acid
  misc_feature (197)..(200): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXDWAXXXIAXALFXXLXPGXXXQXPGXXRPXXFMNMKTXXASXXVHXVXYXLXLXLFXXXLXXHXYXXXX

SEQ ID NO: 94681 - protein, 225 aa, artificial
  consensus sequence
  misc_feature (1)..(145): Xaa can be any naturally occurring amino acid
  misc_feature (153)..(153): Xaa can be any naturally occurring amino acid
  misc_feature (156)..(156): Xaa can be any naturally occurring amino acid
  misc_feature (163)..(163): Xaa can be any naturally occurring amino acid
  misc_feature (170)..(170): Xaa can be any naturally occurring amino acid
  misc_feature (172)..(174): Xaa can be any naturally occurring amino acid
  misc_feature (176)..(178): Xaa can be any naturally occurring amino acid
  misc_feature (181)..(181): Xaa can be any naturally occurring amino acid
  misc_feature (183)..(183): Xaa can be any naturally occurring amino acid
  misc_feature (186)..(188): Xaa can be any naturally occurring amino acid
  misc_feature (193)..(195): Xaa can be any naturally occurring amino acid
  misc_feature (198)..(198): Xaa can be any naturally occurring amino acid
  misc_feature (200)..(200): Xaa can be any naturally occurring amino acid
  misc_feature (205)..(205): Xaa can be any naturally occurring amino acid
  misc_feature (213)..(213): Xaa can be any naturally occurring amino acid
  misc_feature (215)..(225): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMADWGPVXIAXVLFVLLXPGLLFQXPXXXRXXXFGXMXTSXXXILVHXXXYFXLXTIFLXAIGVHIYXGXXXXXXXXXXX

SEQ ID NO: 94682 - protein, 747 aa, artificial
  consensus sequence
  misc_feature (1)..(336): Xaa can be any naturally occurring amino acid
  misc_feature (340)..(422): Xaa can be any naturally occurring amino acid
  misc_feature (424)..(426): Xaa can be any naturally occurring amino acid
  misc_feature (428)..(430): Xaa can be any naturally occurring amino acid
  misc_feature (433)..(457): Xaa can be any naturally occurring amino acid
  misc_feature (459)..(465): Xaa can be any naturally occurring amino acid
  misc_feature (467)..(467): Xaa can be any naturally occurring amino acid
  misc_feature (470)..(475): Xaa can be any naturally occurring amino acid
  misc_feature (477)..(499): Xaa can be any naturally occurring amino acid
  misc_feature (505)..(505): Xaa can be any naturally occurring amino acid
  misc_feature (509)..(581): Xaa can be any naturally occurring amino acid
  misc_feature (584)..(585): Xaa can be any naturally occurring amino acid
  misc_feature (588)..(589): Xaa can be any naturally occurring amino acid
  misc_feature (593)..(593): Xaa can be any naturally occurring amino acid
  misc_feature (596)..(598): Xaa can be any naturally occurring amino acid
  misc_feature (601)..(603): Xaa can be any naturally occurring amino acid
  misc_feature (605)..(629): Xaa can be any naturally occurring amino acid
  misc_feature (631)..(632): Xaa can be any naturally occurring amino acid
  misc_feature (637)..(637): Xaa can be any naturally occurring amino acid
  misc_feature (642)..(642): Xaa can be any naturally occurring amino acid
  misc_feature (648)..(648): Xaa can be any naturally occurring amino acid
  misc_feature (655)..(655): Xaa can be any naturally occurring amino acid
  misc_feature (662)..(663): Xaa can be any naturally occurring amino acid
  misc_feature (665)..(667): Xaa can be any naturally occurring amino acid
  misc_feature (673)..(673): Xaa can be any naturally occurring amino acid
  misc_feature (677)..(677): Xaa can be any naturally occurring amino acid
  misc_feature (679)..(705): Xaa can be any naturally occurring amino acid
  misc_feature (707)..(707): Xaa can be any naturally occurring amino acid
  misc_feature (710)..(710): Xaa can be any naturally occurring amino acid
  misc_feature (713)..(714): Xaa can be any naturally occurring amino acid
  misc_feature (716)..(747): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEQWXXXXXXXXXXXXXXXXXXXXXXXXXXXXXXXXXXXXXXXXXXXXXXXXXXXXXXXXXXXXXXXXXXXXXXXXXXXXXXXXXXXSXXXSXXXSPXXXXXXXXXXXXXXXXXXXXXXXXXSXXXXXXXSXSSXXXXXXSXXXXXXXXXXXXXXXXXXXXXXXDDWEAXADAXXXXXXXXXXXXXXXXXXXXXXXXXXXXXXXXXXXXXXXXXXXXXXXXXXXXXXXXXXXXXXXXXXXXXXXXXAWXXDDXXRPQXLPXXXKQXXXPXXXXXXXXXXXXXXXXXXXXXXXXXPXXCPICXEDLDXTDSSFXPCPCGFXLCLFCHXXIXXXDGRCPXCRKXYXXXXXXXXXXXXXXXXXXXXXXXXXXXLXRSXSMXXRXXXXXXXXXXXXXXXXXXXXXXXXXXXXXXXX

SEQ ID NO: 94683 - protein, 278 aa, artificial
  consensus sequence
  misc_feature (1)..(21): Xaa can be any naturally occurring amino acid
  misc_feature (23)..(29): Xaa can be any naturally occurring amino acid
  misc_feature (31)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (112)..(113): Xaa can be any naturally occurring amino acid
  misc_feature (115)..(115): Xaa can be any naturally occurring amino acid
  misc_feature (118)..(121): Xaa can be any naturally occurring amino acid
  misc_feature (123)..(123): Xaa can be any naturally occurring amino acid
  misc_feature (125)..(136): Xaa can be any naturally occurring amino acid
  misc_feature (141)..(142): Xaa can be any naturally occurring amino acid
  misc_feature (144)..(144): Xaa can be any naturally occurring amino acid
  misc_feature (146)..(146): Xaa can be any naturally occurring amino acid
  misc_feature (148)..(148): Xaa can be any naturally occurring amino acid
  misc_feature (159)..(161): Xaa can be any naturally occurring amino acid
  misc_feature (164)..(164): Xaa can be any naturally occurring amino acid
  misc_feature (167)..(168): Xaa can be any naturally occurring amino acid
  misc_feature (172)..(172): Xaa can be any naturally occurring amino acid
  misc_feature (175)..(176): Xaa can be any naturally occurring amino acid
  misc_feature (180)..(180): Xaa can be any naturally occurring amino acid
  misc_feature (182)..(182): Xaa can be any naturally occurring amino acid
  misc_feature (186)..(230): Xaa can be any naturally occurring amino acid
  misc_feature (233)..(233): Xaa can be any naturally occurring amino acid
  misc_feature (236)..(237): Xaa can be any naturally occurring amino acid
  misc_feature (239)..(239): Xaa can be any naturally occurring amino acid
  misc_feature (242)..(242): Xaa can be any naturally occurring amino acid
  misc_feature (244)..(246): Xaa can be any naturally occurring amino acid
  misc_feature (255)..(255): Xaa can be any naturally occurring amino acid
  misc_feature (259)..(259): Xaa can be any naturally occurring amino acid
  misc_feature (263)..(265): Xaa can be any naturally occurring amino acid
  misc_feature (270)..(270): Xaa can be any naturally occurring amino acid
  misc_feature (275)..(278): Xaa can be any naturally occurring amino acid
XXXXXXXXXXXXXXXXXXXXXMXXXXXXXLXXXXXXXXXXXXXXXXXXXXXXXXXXXXXXXXXXXXXXXXXXXXXXXXXXXXXXXXXXXXXXXXXXXXXIXXPLXXXLKELXXKXVPXXXXKXRXXXXXXXXXXXXIPWHXXNXIXNXHAPEWSGEVRXXXYSXDGXXVSVXYRXXVTLXGXDAEXXXXXXXXXXXXXXXXXXXXXXXXXXXXXXXXXXXXXXXXXXXXXREXTGXXTXSVXDXXXGDPVQKAEXMAFXRACXXXGLGLXLYHEXXXX

SEQ ID NO: 94684 - protein, 2143 aa, artificial
  consensus sequence
  misc_feature (1)..(8): Xaa can be any naturally occurring amino acid
  misc_feature (10)..(11): Xaa can be any naturally occurring amino acid
  misc_feature (13)..(42): Xaa can be any naturally occurring amino acid
  misc_feature (44)..(55): Xaa can be any naturally occurring amino acid
  misc_feature (59)..(59): Xaa can be any naturally occurring amino acid
  misc_feature (62)..(79): Xaa can be any naturally occurring amino acid
  misc_feature (81)..(82): Xaa can be any naturally occurring amino acid
  misc_feature (84)..(174): Xaa can be any naturally occurring amino acid
  misc_feature (176)..(182): Xaa can be any naturally occurring amino acid
  misc_feature (184)..(191): Xaa can be any naturally occurring amino acid
  misc_feature (194)..(194): Xaa can be any naturally occurring amino acid
  misc_feature (196)..(204): Xaa can be any naturally occurring amino acid
  misc_feature (207)..(208): Xaa can be any naturally occurring amino acid
  misc_feature (210)..(212): Xaa can be any naturally occurring amino acid
  misc_feature (214)..(219): Xaa can be any naturally occurring amino acid
  misc_feature (222)..(222): Xaa can be any naturally occurring amino acid
  misc_feature (225)..(225): Xaa can be any naturally occurring amino acid
  misc_feature (230)..(230): Xaa can be any naturally occurring amino acid
  misc_feature (234)..(234): Xaa can be any naturally occurring amino acid
  misc_feature (242)..(242): Xaa can be any naturally occurring amino acid
  misc_feature (251)..(251): Xaa can be any naturally occurring amino acid
  misc_feature (260)..(260): Xaa can be any naturally occurring amino acid
  misc_feature (265)..(266): Xaa can be any naturally occurring amino acid
  misc_feature (269)..(269): Xaa can be any naturally occurring amino acid
  misc_feature (274)..(292): Xaa can be any naturally occurring amino acid
  misc_feature (295)..(295): Xaa can be any naturally occurring amino acid
  misc_feature (300)..(300): Xaa can be any naturally occurring amino acid
  misc_feature (302)..(302): Xaa can be any naturally occurring amino acid
  misc_feature (304)..(304): Xaa can be any naturally occurring amino acid
  misc_feature (306)..(306): Xaa can be any naturally occurring amino acid
  misc_feature (310)..(314): Xaa can be any naturally occurring amino acid
  misc_feature (316)..(318): Xaa can be any naturally occurring amino acid
  misc_feature (320)..(322): Xaa can be any naturally occurring amino acid
  misc_feature (324)..(326): Xaa can be any naturally occurring amino acid
  misc_feature (329)..(337): Xaa can be any naturally occurring amino acid
  misc_feature (339)..(343): Xaa can be any naturally occurring amino acid
  misc_feature (345)..(347): Xaa can be any naturally occurring amino acid
  misc_feature (349)..(353): Xaa can be any naturally occurring amino acid
  misc_feature (356)..(356): Xaa can be any naturally occurring amino acid
  misc_feature (358)..(358): Xaa can be any naturally occurring amino acid
  misc_feature (360)..(360): Xaa can be any naturally occurring amino acid
  misc_feature (363)..(366): Xaa can be any naturally occurring amino acid
  misc_feature (368)..(372): Xaa can be any naturally occurring amino acid
  misc_feature (374)..(439): Xaa can be any naturally occurring amino acid
  misc_feature (441)..(447): Xaa can be any naturally occurring amino acid
  misc_feature (449)..(455): Xaa can be any naturally occurring amino acid
  misc_feature (457)..(466): Xaa can be any naturally occurring amino acid
  misc_feature (468)..(469): Xaa can be any naturally occurring amino acid
  misc_feature (472)..(472): Xaa can be any naturally occurring amino acid
  misc_feature (474)..(474): Xaa can be any naturally occurring amino acid
  misc_feature (477)..(479): Xaa can be any naturally occurring amino acid
  misc_feature (481)..(522): Xaa can be any naturally occurring amino acid
  misc_feature (524)..(560): Xaa can be any naturally occurring amino acid
  misc_feature (562)..(563): Xaa can be any naturally occurring amino acid
  misc_feature (565)..(566): Xaa can be any naturally occurring amino acid
  misc_feature (569)..(573): Xaa can be any naturally occurring amino acid
  misc_feature (576)..(673): Xaa can be any naturally occurring amino acid
  misc_feature (675)..(678): Xaa can be any naturally occurring amino acid
  misc_feature (680)..(680): Xaa can be any naturally occurring amino acid
  misc_feature (682)..(683): Xaa can be any naturally occurring amino acid
  misc_feature (685)..(686): Xaa can be any naturally occurring amino acid
  misc_feature (688)..(688): Xaa can be any naturally occurring amino acid
  misc_feature (690)..(709): Xaa can be any naturally occurring amino acid
  misc_feature (711)..(717): Xaa can be any naturally occurring amino acid
  misc_feature (719)..(722): Xaa can be any naturally occurring amino acid
  misc_feature (724)..(730): Xaa can be any naturally occurring amino acid
  misc_feature (732)..(742): Xaa can be any naturally occurring amino acid
  misc_feature (744)..(781): Xaa can be any naturally occurring amino acid
  misc_feature (783)..(786): Xaa can be any naturally occurring amino acid
  misc_feature (788)..(788): Xaa can be any naturally occurring amino acid
  misc_feature (794)..(794): Xaa can be any naturally occurring amino acid
  misc_feature (796)..(797): Xaa can be any naturally occurring amino acid
  misc_feature (799)..(2143): Xaa can be any naturally occurring amino acid
XXXXXXXXMXXLXXXXXXXXXXXXXXXXXXXXXXXXXXXXXXIXXXXXXXXXXXXEARXWLXXXXXXXXXXXXXXXXXXFXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXAXXXXXXXXFFXGXXXXXXXXXWFXXFXXXGXXXXXXGAXALXQFAFXNRDXCWEELEWXGKHGQSPAXVATKPHYFXDLDVXXTVXNFLEXXXXXXXXXXXXXXXXXXXVPXFWSSXEXAXSXKDGXXXXXDXXXFXXXFXXXMYXXXXXXXXXWXXXXXFXXXEXXXXXFSXLXQXLLXXXXEXXXXXFXXXXXXXXXXXXXXXXXXXXXXXXXXXXXXXXXXXXXXXXXXXXXXXXXXXXXXXXXXXXXXXXXXWXXXXXXXLXXXXXXXSXXXXXXXXXXIXXGRXLXRLXXXEXXXXXXXXXXXXXXXXXXXXXXXXXXXXXXXXXXXXXXXXXXEXXXXXXXXXXXXXXXXXXXXXXXXXXXXXXXXXXXXXKXXGXXSWXXXXXLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXSXEXXFXXNXIXXXXXXXXXXXXXXXXXXXXFXXXXXXXLXXXXGXXXXXXXDXXXXXXXXXXXKXXXXXXXXXXXXXXXXXXXXXXXXXXXXXXXXXXXXXXSXXXXWXLSTDGXSXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94685 - protein, 128 aa, artificial
  consensus sequence
  misc_feature (1)..(25): Xaa can be any naturally occurring amino acid
  misc_feature (28)..(28): Xaa can be any naturally occurring amino acid
  misc_feature (30)..(32): Xaa can be any naturally occurring amino acid
  misc_feature (52)..(52): Xaa can be any naturally occurring amino acid
  misc_feature (56)..(56): Xaa can be any naturally occurring amino acid
  misc_feature (60)..(62): Xaa can be any naturally occurring amino acid
  misc_feature (67)..(67): Xaa can be any naturally occurring amino acid
  misc_feature (70)..(70): Xaa can be any naturally occurring amino acid
  misc_feature (79)..(79): Xaa can be any naturally occurring amino acid
  misc_feature (82)..(82): Xaa can be any naturally occurring amino acid
  misc_feature (89)..(89): Xaa can be any naturally occurring amino acid
  misc_feature (94)..(94): Xaa can be any naturally occurring amino acid
  misc_feature (98)..(99): Xaa can be any naturally occurring amino acid
  misc_feature (102)..(102): Xaa can be any naturally occurring amino acid
  misc_feature (105)..(106): Xaa can be any naturally occurring amino acid
  misc_feature (109)..(115): Xaa can be any naturally occurring amino acid
  misc_feature (117)..(128): Xaa can be any naturally occurring amino acid
XXXXXXXXXXXXXXXXXXXXXXXXXMGXYXXXARENHVKKKVEEALRSKMKXKALXECDXXXSKYAXCAXGRTFSVVWXCRXQAKELNXCLHQXTNDXXLEXMKXXYMXXXXXXXKXXXXXXXXXXXX

SEQ ID NO: 94686 - protein, 1038 aa, artificial
  consensus sequence
  misc_feature (1)..(367): Xaa can be any naturally occurring amino acid
  misc_feature (380)..(380): Xaa can be any naturally occurring amino acid
  misc_feature (382)..(382): Xaa can be any naturally occurring amino acid
  misc_feature (389)..(389): Xaa can be any naturally occurring amino acid
  misc_feature (397)..(445): Xaa can be any naturally occurring amino acid
  misc_feature (448)..(521): Xaa can be any naturally occurring amino acid
  misc_feature (525)..(526): Xaa can be any naturally occurring amino acid
  misc_feature (528)..(533): Xaa can be any naturally occurring amino acid
  misc_feature (535)..(535): Xaa can be any naturally occurring amino acid
  misc_feature (537)..(586): Xaa can be any naturally occurring amino acid
  misc_feature (588)..(620): Xaa can be any naturally occurring amino acid
  misc_feature (623)..(640): Xaa can be any naturally occurring amino acid
  misc_feature (644)..(645): Xaa can be any naturally occurring amino acid
  misc_feature (647)..(717): Xaa can be any naturally occurring amino acid
  misc_feature (719)..(721): Xaa can be any naturally occurring amino acid
  misc_feature (724)..(724): Xaa can be any naturally occurring amino acid
  misc_feature (728)..(730): Xaa can be any naturally occurring amino acid
  misc_feature (732)..(733): Xaa can be any naturally occurring amino acid
  misc_feature (736)..(736): Xaa can be any naturally occurring amino acid
  misc_feature (746)..(746): Xaa can be any naturally occurring amino acid
  misc_feature (749)..(751): Xaa can be any naturally occurring amino acid
  misc_feature (753)..(755): Xaa can be any naturally occurring amino acid
  misc_feature (757)..(777): Xaa can be any naturally occurring amino acid
  misc_feature (779)..(779): Xaa can be any naturally occurring amino acid
  misc_feature (782)..(782): Xaa can be any naturally occurring amino acid
  misc_feature (784)..(784): Xaa can be any naturally occurring amino acid
  misc_feature (786)..(786): Xaa can be any naturally occurring amino acid
  misc_feature (789)..(789): Xaa can be any naturally occurring amino acid
  misc_feature (791)..(803): Xaa can be any naturally occurring amino acid
  misc_feature (805)..(805): Xaa can be any naturally occurring amino acid
  misc_feature (808)..(814): Xaa can be any naturally occurring amino acid
  misc_feature (816)..(816): Xaa can be any naturally occurring amino acid
  misc_feature (818)..(820): Xaa can be any naturally occurring amino acid
  misc_feature (822)..(846): Xaa can be any naturally occurring amino acid
  misc_feature (848)..(853): Xaa can be any naturally occurring amino acid
  misc_feature (855)..(856): Xaa can be any naturally occurring amino acid
  misc_feature (858)..(858): Xaa can be any naturally occurring amino acid
  misc_feature (861)..(976): Xaa can be any naturally occurring amino acid
  misc_feature (979)..(979): Xaa can be any naturally occurring amino acid
  misc_feature (981)..(982): Xaa can be any naturally occurring amino acid
  misc_feature (984)..(986): Xaa can be any naturally occurring amino acid
  misc_feature (988)..(989): Xaa can be any naturally occurring amino acid
  misc_feature (991)..(991): Xaa can be any naturally occurring amino acid
  misc_feature (993)..(994): Xaa can be any naturally occurring amino acid
  misc_feature (996)..(999): Xaa can be any naturally occurring amino acid
  misc_feature (1001)..(1038): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMEEEKAAAYYDEXLXRKGEGAXRFKQGLGXXXXXXXXXXXXXXXXXXXXXXXXXXXXXXXXXXXXXXXXXXXXXXXXXFSXXXXXXXXXXXXXXXXXXXXXXXXXXXXXXXXXXXXXXXXXXXXXXXXXXXXXXXXXXXXXXXXXXXXXXXXXXSFLXXFXXXXXXVXAXXXXXXXXXXXXXXXXXXXXXXXXXXXXXXXXXXXXXXXXXXXXXXXXXXRXXXXXXXXXXXXXXXXXXXXXXXXXXXXXXXXXSRXXXXXXXXXXXXXXXXXXRSRXXSXXXXXXXXXXXXXXXXXXXXXXXXXXXXXXXXXXXXXXXXXXXXXXXXXXXXXXXXXXXXXXXXXXXXXXXDXXXLIXGYDXXXMXXAEXVKAKMKLQLXETXXXDXXXGXXXXXXXXXXXXXXXXXXXXXWXRFXFXKXAPXDXXXXXXXXXXXXXAXDDXXXXXXXGXSXXXSXXXXXXXXXXXXXXXXXXXXXXXXXEXXXXXXHXXAXFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLXSXXVXXXQXXSXWXXRXXXXRXXXXXXXXXXXXXXXXXXXXXXXXXXXXXXXXXXXXXX

SEQ ID NO: 94687 - protein, 129 aa, artificial
  consensus sequence
  misc_feature (1)..(25): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (37)..(38): Xaa can be any naturally occurring amino acid
  misc_feature (41)..(41): Xaa can be any naturally occurring amino acid
  misc_feature (48)..(48): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(70): Xaa can be any naturally occurring amino acid
  misc_feature (72)..(79): Xaa can be any naturally occurring amino acid
  misc_feature (81)..(83): Xaa can be any naturally occurring amino acid
  misc_feature (85)..(129): Xaa can be any naturally occurring amino acid
XXXXXXXXXXXXXXXXXXXXXXXXXMVXVXTXFXMTXXAFXFWQSMDXVHVWXIALXQXDEKXERXEXEXEXXXXXXXXLXXXAXXXXXXXXXXXXXXXXXXXXXXXXXXXXXXXXXXXXXXXXXXXXX

SEQ ID NO: 94688 - protein, 540 aa, artificial
  consensus sequence
  misc_feature (1)..(16): Xaa can be any naturally occurring amino acid
  misc_feature (19)..(19): Xaa can be any naturally occurring amino acid
  misc_feature (22)..(87): Xaa can be any naturally occurring amino acid
  misc_feature (89)..(93): Xaa can be any naturally occurring amino acid
  misc_feature (95)..(119): Xaa can be any naturally occurring amino acid
  misc_feature (121)..(121): Xaa can be any naturally occurring amino acid
  misc_feature (124)..(124): Xaa can be any naturally occurring amino acid
  misc_feature (127)..(135): Xaa can be any naturally occurring amino acid
  misc_feature (138)..(140): Xaa can be any naturally occurring amino acid
  misc_feature (142)..(150): Xaa can be any naturally occurring amino acid
  misc_feature (152)..(154): Xaa can be any naturally occurring amino acid
  misc_feature (156)..(159): Xaa can be any naturally occurring amino acid
  misc_feature (161)..(161): Xaa can be any naturally occurring amino acid
  misc_feature (166)..(168): Xaa can be any naturally occurring amino acid
  misc_feature (170)..(181): Xaa can be any naturally occurring amino acid
  misc_feature (183)..(209): Xaa can be any naturally occurring amino acid
  misc_feature (211)..(212): Xaa can be any naturally occurring amino acid
  misc_feature (214)..(215): Xaa can be any naturally occurring amino acid
  misc_feature (217)..(217): Xaa can be any naturally occurring amino acid
  misc_feature (219)..(221): Xaa can be any naturally occurring amino acid
  misc_feature (223)..(540): Xaa can be any naturally occurring amino acid
XXXXXXXXXXXXXXXXLLXWSXXXXXXXXXXXXXXXXXXXXXXXXXXXXXXXXXXXXXXXXXXXXXXXXXXXXXXXXXXXXXXXXXXMXXXXXVXXXXXXXXXXXXXXXXXXXXXXXXXEXIDXANXXXXXXXXXPLXXXLXXXXXXXXXRXXXAXXXXTXVQNNXXXQXXXXXXXXXXXXLXXXXXXXXXXXXXXXXXXXXXXXXXXXRXXAXXAXSXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94689 - protein, 783 aa, artificial
  consensus sequence
  misc_feature (1)..(99): Xaa can be any naturally occurring amino acid
  misc_feature (101)..(110): Xaa can be any naturally occurring amino acid
  misc_feature (117)..(117): Xaa can be any naturally occurring amino acid
  misc_feature (119)..(128): Xaa can be any naturally occurring amino acid
  misc_feature (130)..(131): Xaa can be any naturally occurring amino acid
  misc_feature (133)..(133): Xaa can be any naturally occurring amino acid
  misc_feature (135)..(138): Xaa can be any naturally occurring amino acid
  misc_feature (141)..(141): Xaa can be any naturally occurring amino acid
  misc_feature (143)..(145): Xaa can be any naturally occurring amino acid
  misc_feature (147)..(148): Xaa can be any naturally occurring amino acid
  misc_feature (151)..(159): Xaa can be any naturally occurring amino acid
  misc_feature (161)..(161): Xaa can be any naturally occurring amino acid
  misc_feature (163)..(165): Xaa can be any naturally occurring amino acid
  misc_feature (168)..(168): Xaa can be any naturally occurring amino acid
  misc_feature (171)..(173): Xaa can be any naturally occurring amino acid
  misc_feature (176)..(178): Xaa can be any naturally occurring amino acid
  misc_feature (182)..(184): Xaa can be any naturally occurring amino acid
  misc_feature (186)..(187): Xaa can be any naturally occurring amino acid
  misc_feature (189)..(190): Xaa can be any naturally occurring amino acid
  misc_feature (192)..(192): Xaa can be any naturally occurring amino acid
  misc_feature (194)..(201): Xaa can be any naturally occurring amino acid
  misc_feature (203)..(204): Xaa can be any naturally occurring amino acid
  misc_feature (207)..(207): Xaa can be any naturally occurring amino acid
  misc_feature (209)..(215): Xaa can be any naturally occurring amino acid
  misc_feature (217)..(217): Xaa can be any naturally occurring amino acid
  misc_feature (219)..(219): Xaa can be any naturally occurring amino acid
  misc_feature (221)..(229): Xaa can be any naturally occurring amino acid
  misc_feature (232)..(236): Xaa can be any naturally occurring amino acid
  misc_feature (239)..(243): Xaa can be any naturally occurring amino acid
  misc_feature (245)..(312): Xaa can be any naturally occurring amino acid
  misc_feature (314)..(315): Xaa can be any naturally occurring amino acid
  misc_feature (317)..(326): Xaa can be any naturally occurring amino acid
  misc_feature (328)..(346): Xaa can be any naturally occurring amino acid
  misc_feature (348)..(348): Xaa can be any naturally occurring amino acid
  misc_feature (350)..(496): Xaa can be any naturally occurring amino acid
  misc_feature (498)..(519): Xaa can be any naturally occurring amino acid
  misc_feature (521)..(525): Xaa can be any naturally occurring amino acid
  misc_feature (527)..(534): Xaa can be any naturally occurring amino acid
  misc_feature (537)..(537): Xaa can be any naturally occurring amino acid
  misc_feature (539)..(539): Xaa can be any naturally occurring amino acid
  misc_feature (541)..(542): Xaa can be any naturally occurring amino acid
  misc_feature (547)..(547): Xaa can be any naturally occurring amino acid
  misc_feature (549)..(549): Xaa can be any naturally occurring amino acid
  misc_feature (552)..(553): Xaa can be any naturally occurring amino acid
  misc_feature (561)..(561): Xaa can be any naturally occurring amino acid
  misc_feature (565)..(566): Xaa can be any naturally occurring amino acid
  misc_feature (568)..(569): Xaa can be any naturally occurring amino acid
  misc_feature (571)..(638): Xaa can be any naturally occurring amino acid
  misc_feature (640)..(654): Xaa can be any naturally occurring amino acid
  misc_feature (658)..(659): Xaa can be any naturally occurring amino acid
  misc_feature (661)..(662): Xaa can be any naturally occurring amino acid
  misc_feature (666)..(666): Xaa can be any naturally occurring amino acid
  misc_feature (669)..(672): Xaa can be any naturally occurring amino acid
  misc_feature (674)..(690): Xaa can be any naturally occurring amino acid
  misc_feature (692)..(692): Xaa can be any naturally occurring amino acid
  misc_feature (695)..(696): Xaa can be any naturally occurring amino acid
  misc_feature (700)..(700): Xaa can be any naturally occurring amino acid
  misc_feature (703)..(703): Xaa can be any naturally occurring amino acid
  misc_feature (707)..(708): Xaa can be any naturally occurring amino acid
  misc_feature (710)..(710): Xaa can be any naturally occurring amino acid
  misc_feature (712)..(730): Xaa can be any naturally occurring amino acid
  misc_feature (732)..(733): Xaa can be any naturally occurring amino acid
  misc_feature (736)..(736): Xaa can be any naturally occurring amino acid
  misc_feature (738)..(738): Xaa can be any naturally occurring amino acid
  misc_feature (740)..(740): Xaa can be any naturally occurring amino acid
  misc_feature (743)..(743): Xaa can be any naturally occurring amino acid
  misc_feature (745)..(745): Xaa can be any naturally occurring amino acid
  misc_feature (750)..(751): Xaa can be any naturally occurring amino acid
  misc_feature (756)..(756): Xaa can be any naturally occurring amino acid
  misc_feature (758)..(769): Xaa can be any naturally occurring amino acid
  misc_feature (772)..(774): Xaa can be any naturally occurring amino acid
  misc_feature (776)..(776): Xaa can be any naturally occurring amino acid
  misc_feature (778)..(779): Xaa can be any naturally occurring amino acid
  misc_feature (783)..(783): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXRSKLFRXLXXXXXXXXXXLXXGXRXXXXLPXPXXXAXXLRXXXXXXXXXEXWXXXFGXHYXXXRLXXXYLKXXXRXXFXXLXAXXXXXXXXRXXREXRXXXXXXXKXEXLXXXXXXXXXEIXXXXXEIXXXXXIXXXXXXXXXXXXXXXXXXXXXXXXXXXXXXXXXXXXXXXXXXXXXXXXXXXXXXXXXXXXXXXXXXXXFXXLXXXXXXXXXXHXXXXXXXXXXXXXXXXXXXRXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXNXXXXXYXXXXXXXXPCXAXLXXGGLCXRXDLXXCPFHGPIXPRDXXGXXIXXXXXXXXXXXXXXXXXXXXXXXXXXXXXXXXXXXXXXXXXXXXXXXXXXXXXXXXXXXXXXXXXXXXSXXXXXXXXXXXXXXXQLAXXAXXNVRXRDXXXXKXXXXXXXXXXXXXXXXXRXHNXXVLRXAAXASTXXSXAXXXXXXXXXXXXXXXXXXXKXXTLXSXLXKKXTXKDRIXXRLLNXRXXXXXXXXXXXXEDXXXRXAXXNQWX

SEQ ID NO: 94690 - protein, 276 aa, artificial
  consensus sequence
  misc_feature (1)..(7): Xaa can be any naturally occurring amino acid
  misc_feature (9)..(12): Xaa can be any naturally occurring amino acid
  misc_feature (14)..(14): Xaa can be any naturally occurring amino acid
  misc_feature (17)..(19): Xaa can be any naturally occurring amino acid
  misc_feature (25)..(25): Xaa can be any naturally occurring amino acid
  misc_feature (29)..(82): Xaa can be any naturally occurring amino acid
  misc_feature (87)..(87): Xaa can be any naturally occurring amino acid
  misc_feature (91)..(91): Xaa can be any naturally occurring amino acid
  misc_feature (95)..(95): Xaa can be any naturally occurring amino acid
  misc_feature (101)..(102): Xaa can be any naturally occurring amino acid
  misc_feature (105)..(109): Xaa can be any naturally occurring amino acid
  misc_feature (111)..(126): Xaa can be any naturally occurring amino acid
  misc_feature (128)..(128): Xaa can be any naturally occurring amino acid
  misc_feature (130)..(130): Xaa can be any naturally occurring amino acid
  misc_feature (133)..(133): Xaa can be any naturally occurring amino acid
  misc_feature (135)..(144): Xaa can be any naturally occurring amino acid
  misc_feature (147)..(147): Xaa can be any naturally occurring amino acid
  misc_feature (149)..(149): Xaa can be any naturally occurring amino acid
  misc_feature (153)..(156): Xaa can be any naturally occurring amino acid
  misc_feature (162)..(163): Xaa can be any naturally occurring amino acid
  misc_feature (166)..(166): Xaa can be any naturally occurring amino acid
  misc_feature (169)..(169): Xaa can be any naturally occurring amino acid
  misc_feature (174)..(174): Xaa can be any naturally occurring amino acid
  misc_feature (177)..(178): Xaa can be any naturally occurring amino acid
  misc_feature (180)..(180): Xaa can be any naturally occurring amino acid
  misc_feature (184)..(186): Xaa can be any naturally occurring amino acid
  misc_feature (188)..(188): Xaa can be any naturally occurring amino acid
  misc_feature (194)..(194): Xaa can be any naturally occurring amino acid
  misc_feature (196)..(206): Xaa can be any naturally occurring amino acid
  misc_feature (209)..(211): Xaa can be any naturally occurring amino acid
  misc_feature (213)..(214): Xaa can be any naturally occurring amino acid
  misc_feature (218)..(219): Xaa can be any naturally occurring amino acid
  misc_feature (221)..(276): Xaa can be any naturally occurring amino acid
XXXXXXXKXXXXLXEKXXXLRSITXSHAXXXXXXXXXXXXXXXXXXXXXXXXXXXXXXXXXXXXXXXXXXXXXXXXXXXXXXTSIIXDASXYIKXLKQKVXXLNXXXXXAXXXXXXXXXXXXXXXXPXVXVEXLXXXXXXXXXXNVXSXKSCXXXXPGLLVXXLEXAFXELGLXVLXXAXASCXXXDXFRLEAXGXXXXXXXXXXXVDXXXVXXQAVXXAXXXXXXXXXXXXXXXXXXXXXXXXXXXXXXXXXXXXXXXXXXXXXXXXXXXXXXXX

SEQ ID NO: 94691 - protein, 226 aa, artificial
  consensus sequence
  misc_feature (1)..(10): Xaa can be any naturally occurring amino acid
  misc_feature (12)..(13): Xaa can be any naturally occurring amino acid
  misc_feature (17)..(31): Xaa can be any naturally occurring amino acid
  misc_feature (33)..(34): Xaa can be any naturally occurring amino acid
  misc_feature (37)..(38): Xaa can be any naturally occurring amino acid
  misc_feature (41)..(41): Xaa can be any naturally occurring amino acid
  misc_feature (43)..(44): Xaa can be any naturally occurring amino acid
  misc_feature (47)..(47): Xaa can be any naturally occurring amino acid
  misc_feature (50)..(73): Xaa can be any naturally occurring amino acid
  misc_feature (75)..(80): Xaa can be any naturally occurring amino acid
  misc_feature (82)..(103): Xaa can be any naturally occurring amino acid
  misc_feature (105)..(106): Xaa can be any naturally occurring amino acid
  misc_feature (109)..(109): Xaa can be any naturally occurring amino acid
  misc_feature (112)..(113): Xaa can be any naturally occurring amino acid
  misc_feature (115)..(116): Xaa can be any naturally occurring amino acid
  misc_feature (120)..(120): Xaa can be any naturally occurring amino acid
  misc_feature (126)..(127): Xaa can be any naturally occurring amino acid
  misc_feature (131)..(162): Xaa can be any naturally occurring amino acid
  misc_feature (168)..(168): Xaa can be any naturally occurring amino acid
  misc_feature (170)..(170): Xaa can be any naturally occurring amino acid
  misc_feature (172)..(191): Xaa can be any naturally occurring amino acid
  misc_feature (193)..(226): Xaa can be any naturally occurring amino acid
XXXXXXXXXXPXXRSDXXXXXXXXXXXXXXXRXXFDXXAPXRXXKPXRSXXXXXXXXXXXXXXXXXXXXXXXXEXXXXXXLXXXXXXXXXXXXXXXXXXXXXXEXXETXYYXXLXXIDKXHHTTGXXGFIXXXXXXXXXXXXXXXXXXXXXXXXXXXXXXXXNPATNXWXPXXXXXXXXXXXXXXXXXXXXSXXXXXXXXXXXXXXXXXXXXXXXXXXXXXXXXXX

SEQ ID NO: 94692 - protein, 200 aa, artificial
  consensus sequence
  misc_feature (1)..(18): Xaa can be any naturally occurring amino acid
  misc_feature (20)..(31): Xaa can be any naturally occurring amino acid
  misc_feature (33)..(38): Xaa can be any naturally occurring amino acid
  misc_feature (41)..(43): Xaa can be any naturally occurring amino acid
  misc_feature (46)..(47): Xaa can be any naturally occurring amino acid
  misc_feature (49)..(79): Xaa can be any naturally occurring amino acid
  misc_feature (81)..(81): Xaa can be any naturally occurring amino acid
  misc_feature (84)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (99)..(99): Xaa can be any naturally occurring amino acid
  misc_feature (106)..(110): Xaa can be any naturally occurring amino acid
  misc_feature (113)..(113): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(122): Xaa can be any naturally occurring amino acid
  misc_feature (125)..(125): Xaa can be any naturally occurring amino acid
  misc_feature (128)..(128): Xaa can be any naturally occurring amino acid
  misc_feature (130)..(132): Xaa can be any naturally occurring amino acid
  misc_feature (134)..(161): Xaa can be any naturally occurring amino acid
  misc_feature (163)..(164): Xaa can be any naturally occurring amino acid
  misc_feature (166)..(166): Xaa can be any naturally occurring amino acid
  misc_feature (168)..(172): Xaa can be any naturally occurring amino acid
  misc_feature (174)..(176): Xaa can be any naturally occurring amino acid
  misc_feature (178)..(178): Xaa can be any naturally occurring amino acid
  misc_feature (181)..(181): Xaa can be any naturally occurring amino acid
  misc_feature (183)..(185): Xaa can be any naturally occurring amino acid
  misc_feature (187)..(200): Xaa can be any naturally occurring amino acid
XXXXXXXXXXXXXXXXXXGXXXXXXXXXXXXEXXXXXXSSXXXDSXXEXXXXXXXXXXXXXXXXXXXXXXXXXXXXXXXDXSSXXXQLPXKXGLSXYYXGKSQSFXXXXXVRXLEDLXKXEXPYXKKXKXXXSXXXXXXXXXXXXXXXXXXXXXXXXXXXXCXXLXAXXXXXNXXXRXPPXPXXXSXXXXXXXXXXXXXX

SEQ ID NO: 94693 - protein, 488 aa, artificial
  consensus sequence
  misc_feature (1)..(18): Xaa can be any naturally occurring amino acid
  misc_feature (20)..(62): Xaa can be any naturally occurring amino acid
  misc_feature (65)..(65): Xaa can be any naturally occurring amino acid
  misc_feature (67)..(72): Xaa can be any naturally occurring amino acid
  misc_feature (74)..(75): Xaa can be any naturally occurring amino acid
  misc_feature (79)..(79): Xaa can be any naturally occurring amino acid
  misc_feature (81)..(83): Xaa can be any naturally occurring amino acid
  misc_feature (87)..(87): Xaa can be any naturally occurring amino acid
  misc_feature (92)..(92): Xaa can be any naturally occurring amino acid
  misc_feature (95)..(262): Xaa can be any naturally occurring amino acid
  misc_feature (268)..(269): Xaa can be any naturally occurring amino acid
  misc_feature (271)..(271): Xaa can be any naturally occurring amino acid
  misc_feature (273)..(273): Xaa can be any naturally occurring amino acid
  misc_feature (275)..(279): Xaa can be any naturally occurring amino acid
  misc_feature (281)..(288): Xaa can be any naturally occurring amino acid
  misc_feature (291)..(291): Xaa can be any naturally occurring amino acid
  misc_feature (297)..(297): Xaa can be any naturally occurring amino acid
  misc_feature (301)..(301): Xaa can be any naturally occurring amino acid
  misc_feature (303)..(303): Xaa can be any naturally occurring amino acid
  misc_feature (305)..(305): Xaa can be any naturally occurring amino acid
  misc_feature (308)..(312): Xaa can be any naturally occurring amino acid
  misc_feature (314)..(315): Xaa can be any naturally occurring amino acid
  misc_feature (317)..(318): Xaa can be any naturally occurring amino acid
  misc_feature (320)..(322): Xaa can be any naturally occurring amino acid
  misc_feature (324)..(330): Xaa can be any naturally occurring amino acid
  misc_feature (332)..(349): Xaa can be any naturally occurring amino acid
  misc_feature (352)..(353): Xaa can be any naturally occurring amino acid
  misc_feature (355)..(360): Xaa can be any naturally occurring amino acid
  misc_feature (362)..(369): Xaa can be any naturally occurring amino acid
  misc_feature (371)..(372): Xaa can be any naturally occurring amino acid
  misc_feature (374)..(374): Xaa can be any naturally occurring amino acid
  misc_feature (376)..(377): Xaa can be any naturally occurring amino acid
  misc_feature (380)..(384): Xaa can be any naturally occurring amino acid
  misc_feature (390)..(390): Xaa can be any naturally occurring amino acid
  misc_feature (393)..(393): Xaa can be any naturally occurring amino acid
  misc_feature (396)..(398): Xaa can be any naturally occurring amino acid
  misc_feature (401)..(402): Xaa can be any naturally occurring amino acid
  misc_feature (414)..(414): Xaa can be any naturally occurring amino acid
  misc_feature (416)..(417): Xaa can be any naturally occurring amino acid
  misc_feature (419)..(488): Xaa can be any naturally occurring amino acid
XXXXXXXXXXXXXXXXXXSXXXXXXXXXXXXXXXXXXXXXXXXXXXXXXXXXXXXXXXXXXXLYXTXXXXXXPXXPSSXPXXXSPYXINHKXRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFYDAXXEXSXDXXXXXSXXXXXXXXREXRLSLLXEIEXRXQXEEXXXXXQXXWXXLXXXLXXXXXXXPXXXXXXXXXXXXXXXXXXELXXQXXXXXXVXXXXXXXXAXXEXEXXMEXXXXXKNFEIXRLXDRXXXYEXXNREMSQRNQEAXEXXRXXXXXXXXXXXXXXXXXXXXXXXXXXXXXXXXXXXXXXXXXXXXXXXXXXXXXXXXXXXXXXXXXXXXXX

SEQ ID NO: 94694 - protein, 1327 aa, artificial
  consensus sequence
  misc_feature (1)..(402): Xaa can be any naturally occurring amino acid
  misc_feature (404)..(406): Xaa can be any naturally occurring amino acid
  misc_feature (408)..(409): Xaa can be any naturally occurring amino acid
  misc_feature (413)..(458): Xaa can be any naturally occurring amino acid
  misc_feature (460)..(470): Xaa can be any naturally occurring amino acid
  misc_feature (472)..(484): Xaa can be any naturally occurring amino acid
  misc_feature (486)..(488): Xaa can be any naturally occurring amino acid
  misc_feature (490)..(491): Xaa can be any naturally occurring amino acid
  misc_feature (493)..(494): Xaa can be any naturally occurring amino acid
  misc_feature (498)..(499): Xaa can be any naturally occurring amino acid
  misc_feature (501)..(501): Xaa can be any naturally occurring amino acid
  misc_feature (505)..(507): Xaa can be any naturally occurring amino acid
  misc_feature (509)..(513): Xaa can be any naturally occurring amino acid
  misc_feature (515)..(518): Xaa can be any naturally occurring amino acid
  misc_feature (521)..(521): Xaa can be any naturally occurring amino acid
  misc_feature (523)..(523): Xaa can be any naturally occurring amino acid
  misc_feature (529)..(529): Xaa can be any naturally occurring amino acid
  misc_feature (531)..(533): Xaa can be any naturally occurring amino acid
  misc_feature (535)..(535): Xaa can be any naturally occurring amino acid
  misc_feature (538)..(539): Xaa can be any naturally occurring amino acid
  misc_feature (541)..(543): Xaa can be any naturally occurring amino acid
  misc_feature (545)..(546): Xaa can be any naturally occurring amino acid
  misc_feature (549)..(553): Xaa can be any naturally occurring amino acid
  misc_feature (560)..(561): Xaa can be any naturally occurring amino acid
  misc_feature (563)..(566): Xaa can be any naturally occurring amino acid
  misc_feature (568)..(569): Xaa can be any naturally occurring amino acid
  misc_feature (571)..(571): Xaa can be any naturally occurring amino acid
  misc_feature (573)..(1327): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXLXXQLAXXXXXXXXXXXXXXXXXXXXXXXXXXXXXXXXXXXXXXXXXXXXXXPXXXXXXXXXXXPXXXXXXXXXXXXXEXXXIXXVXXESEXXVXEKLXXXEXXXXXEXXXXAKXLXDKEFKXPXXXPXPCXXEXXXCXXCYXXXXXDPLKCAXXVXXXXFXXCXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94695 - protein, 758 aa, artificial
  consensus sequence
  misc_feature (1)..(184): Xaa can be any naturally occurring amino acid
  misc_feature (186)..(189): Xaa can be any naturally occurring amino acid
  misc_feature (193)..(194): Xaa can be any naturally occurring amino acid
  misc_feature (196)..(197): Xaa can be any naturally occurring amino acid
  misc_feature (199)..(204): Xaa can be any naturally occurring amino acid
  misc_feature (207)..(207): Xaa can be any naturally occurring amino acid
  misc_feature (212)..(212): Xaa can be any naturally occurring amino acid
  misc_feature (216)..(216): Xaa can be any naturally occurring amino acid
  misc_feature (220)..(222): Xaa can be any naturally occurring amino acid
  misc_feature (224)..(225): Xaa can be any naturally occurring amino acid
  misc_feature (228)..(228): Xaa can be any naturally occurring amino acid
  misc_feature (230)..(231): Xaa can be any naturally occurring amino acid
  misc_feature (233)..(357): Xaa can be any naturally occurring amino acid
  misc_feature (360)..(362): Xaa can be any naturally occurring amino acid
  misc_feature (364)..(368): Xaa can be any naturally occurring amino acid
  misc_feature (370)..(370): Xaa can be any naturally occurring amino acid
  misc_feature (372)..(758): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXQAFXXLXXSXXXXXXAQXVVASXASDXNVWXXXVXXNEXVXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAXXXIXXXXXKXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94696 - protein, 532 aa, artificial
  consensus sequence
  misc_feature (1)..(216): Xaa can be any naturally occurring amino acid
  misc_feature (218)..(262): Xaa can be any naturally occurring amino acid
  misc_feature (264)..(266): Xaa can be any naturally occurring amino acid
  misc_feature (268)..(270): Xaa can be any naturally occurring amino acid
  misc_feature (272)..(274): Xaa can be any naturally occurring amino acid
  misc_feature (276)..(276): Xaa can be any naturally occurring amino acid
  misc_feature (278)..(285): Xaa can be any naturally occurring amino acid
  misc_feature (287)..(287): Xaa can be any naturally occurring amino acid
  misc_feature (289)..(289): Xaa can be any naturally occurring amino acid
  misc_feature (291)..(291): Xaa can be any naturally occurring amino acid
  misc_feature (294)..(307): Xaa can be any naturally occurring amino acid
  misc_feature (309)..(310): Xaa can be any naturally occurring amino acid
  misc_feature (312)..(312): Xaa can be any naturally occurring amino acid
  misc_feature (314)..(344): Xaa can be any naturally occurring amino acid
  misc_feature (347)..(350): Xaa can be any naturally occurring amino acid
  misc_feature (352)..(353): Xaa can be any naturally occurring amino acid
  misc_feature (356)..(356): Xaa can be any naturally occurring amino acid
  misc_feature (359)..(361): Xaa can be any naturally occurring amino acid
  misc_feature (364)..(364): Xaa can be any naturally occurring amino acid
  misc_feature (366)..(373): Xaa can be any naturally occurring amino acid
  misc_feature (375)..(376): Xaa can be any naturally occurring amino acid
  misc_feature (378)..(382): Xaa can be any naturally occurring amino acid
  misc_feature (385)..(386): Xaa can be any naturally occurring amino acid
  misc_feature (389)..(392): Xaa can be any naturally occurring amino acid
  misc_feature (394)..(394): Xaa can be any naturally occurring amino acid
  misc_feature (396)..(398): Xaa can be any naturally occurring amino acid
  misc_feature (401)..(416): Xaa can be any naturally occurring amino acid
  misc_feature (418)..(420): Xaa can be any naturally occurring amino acid
  misc_feature (422)..(426): Xaa can be any naturally occurring amino acid
  misc_feature (430)..(430): Xaa can be any naturally occurring amino acid
  misc_feature (432)..(435): Xaa can be any naturally occurring amino acid
  misc_feature (437)..(439): Xaa can be any naturally occurring amino acid
  misc_feature (442)..(442): Xaa can be any naturally occurring amino acid
  misc_feature (444)..(446): Xaa can be any naturally occurring amino acid
  misc_feature (448)..(461): Xaa can be any naturally occurring amino acid
  misc_feature (465)..(532): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXFXXXEXXXLXXXFXKXXXXXXXXGXIXKXEFXXXXXXXXXXXXXXNXXAXRXXXXXXXXXXXXXXXXXXXXXXXXXXXXXXXFDXXXXGXXDFXEFXXXLSXFXXXXXXXXKXXFXXXXXAFXXYDXXXXGXIXXXELXXXXXXXXXXXXXXXXLXXXDXXXXXIVDXTXXXXDXXXDGXIXXXEXXXXXXXXXXXXXXMTLXXXXXXXXXXXXXXXXXXXXXXXXXXXXXXXXXXXXXXXXXXXXXXXXXXXXXXXXXXXXXXXXXXXX

SEQ ID NO: 94697 - protein, 2289 aa, artificial
  consensus sequence
  misc_feature (1)..(561): Xaa can be any naturally occurring amino acid
  misc_feature (564)..(572): Xaa can be any naturally occurring amino acid
  misc_feature (574)..(588): Xaa can be any naturally occurring amino acid
  misc_feature (591)..(591): Xaa can be any naturally occurring amino acid
  misc_feature (594)..(594): Xaa can be any naturally occurring amino acid
  misc_feature (596)..(597): Xaa can be any naturally occurring amino acid
  misc_feature (599)..(599): Xaa can be any naturally occurring amino acid
  misc_feature (601)..(638): Xaa can be any naturally occurring amino acid
  misc_feature (640)..(643): Xaa can be any naturally occurring amino acid
  misc_feature (645)..(645): Xaa can be any naturally occurring amino acid
  misc_feature (647)..(647): Xaa can be any naturally occurring amino acid
  misc_feature (649)..(649): Xaa can be any naturally occurring amino acid
  misc_feature (651)..(651): Xaa can be any naturally occurring amino acid
  misc_feature (653)..(654): Xaa can be any naturally occurring amino acid
  misc_feature (657)..(657): Xaa can be any naturally occurring amino acid
  misc_feature (659)..(667): Xaa can be any naturally occurring amino acid
  misc_feature (669)..(720): Xaa can be any naturally occurring amino acid
  misc_feature (723)..(727): Xaa can be any naturally occurring amino acid
  misc_feature (729)..(729): Xaa can be any naturally occurring amino acid
  misc_feature (732)..(735): Xaa can be any naturally occurring amino acid
  misc_feature (738)..(738): Xaa can be any naturally occurring amino acid
  misc_feature (743)..(743): Xaa can be any naturally occurring amino acid
  misc_feature (747)..(749): Xaa can be any naturally occurring amino acid
  misc_feature (751)..(764): Xaa can be any naturally occurring amino acid
  misc_feature (766)..(767): Xaa can be any naturally occurring amino acid
  misc_feature (769)..(769): Xaa can be any naturally occurring amino acid
  misc_feature (773)..(775): Xaa can be any naturally occurring amino acid
  misc_feature (777)..(782): Xaa can be any naturally occurring amino acid
  misc_feature (784)..(799): Xaa can be any naturally occurring amino acid
  misc_feature (801)..(808): Xaa can be any naturally occurring amino acid
  misc_feature (811)..(817): Xaa can be any naturally occurring amino acid
  misc_feature (819)..(823): Xaa can be any naturally occurring amino acid
  misc_feature (825)..(832): Xaa can be any naturally occurring amino acid
  misc_feature (834)..(836): Xaa can be any naturally occurring amino acid
  misc_feature (838)..(839): Xaa can be any naturally occurring amino acid
  misc_feature (842)..(842): Xaa can be any naturally occurring amino acid
  misc_feature (844)..(849): Xaa can be any naturally occurring amino acid
  misc_feature (853)..(883): Xaa can be any naturally occurring amino acid
  misc_feature (885)..(964): Xaa can be any naturally occurring amino acid
  misc_feature (966)..(971): Xaa can be any naturally occurring amino acid
  misc_feature (973)..(978): Xaa can be any naturally occurring amino acid
  misc_feature (980)..(1008): Xaa can be any naturally occurring amino acid
  misc_feature (1010)..(1068): Xaa can be any naturally occurring amino acid
  misc_feature (1070)..(1075): Xaa can be any naturally occurring amino acid
  misc_feature (1077)..(1079): Xaa can be any naturally occurring amino acid
  misc_feature (1081)..(1090): Xaa can be any naturally occurring amino acid
  misc_feature (1092)..(1104): Xaa can be any naturally occurring amino acid
  misc_feature (1106)..(1117): Xaa can be any naturally occurring amino acid
  misc_feature (1120)..(1122): Xaa can be any naturally occurring amino acid
  misc_feature (1124)..(1135): Xaa can be any naturally occurring amino acid
  misc_feature (1138)..(1148): Xaa can be any naturally occurring amino acid
  misc_feature (1150)..(1164): Xaa can be any naturally occurring amino acid
  misc_feature (1166)..(1178): Xaa can be any naturally occurring amino acid
  misc_feature (1180)..(1181): Xaa can be any naturally occurring amino acid
  misc_feature (1183)..(1187): Xaa can be any naturally occurring amino acid
  misc_feature (1189)..(1190): Xaa can be any naturally occurring amino acid
  misc_feature (1192)..(1198): Xaa can be any naturally occurring amino acid
  misc_feature (1202)..(1267): Xaa can be any naturally occurring amino acid
  misc_feature (1269)..(1290): Xaa can be any naturally occurring amino acid
  misc_feature (1292)..(1294): Xaa can be any naturally occurring amino acid
  misc_feature (1296)..(1407): Xaa can be any naturally occurring amino acid
  misc_feature (1409)..(1412): Xaa can be any naturally occurring amino acid
  misc_feature (1414)..(1449): Xaa can be any naturally occurring amino acid
  misc_feature (1451)..(1452): Xaa can be any naturally occurring amino acid
  misc_feature (1454)..(1454): Xaa can be any naturally occurring amino acid
  misc_feature (1456)..(1458): Xaa can be any naturally occurring amino acid
  misc_feature (1461)..(1462): Xaa can be any naturally occurring amino acid
  misc_feature (1468)..(1468): Xaa can be any naturally occurring amino acid
  misc_feature (1478)..(1479): Xaa can be any naturally occurring amino acid
  misc_feature (1481)..(1482): Xaa can be any naturally occurring amino acid
  misc_feature (1484)..(1486): Xaa can be any naturally occurring amino acid
  misc_feature (1488)..(1491): Xaa can be any naturally occurring amino acid
  misc_feature (1493)..(1502): Xaa can be any naturally occurring amino acid
  misc_feature (1504)..(1510): Xaa can be any naturally occurring amino acid
  misc_feature (1512)..(1512): Xaa can be any naturally occurring amino acid
  misc_feature (1514)..(1515): Xaa can be any naturally occurring amino acid
  misc_feature (1518)..(1519): Xaa can be any naturally occurring amino acid
  misc_feature (1521)..(1521): Xaa can be any naturally occurring amino acid
  misc_feature (1523)..(1523): Xaa can be any naturally occurring amino acid
  misc_feature (1525)..(1528): Xaa can be any naturally occurring amino acid
  misc_feature (1533)..(1533): Xaa can be any naturally occurring amino acid
  misc_feature (1535)..(1535): Xaa can be any naturally occurring amino acid
  misc_feature (1539)..(1539): Xaa can be any naturally occurring amino acid
  misc_feature (1542)..(1564): Xaa can be any naturally occurring amino acid
  misc_feature (1566)..(1568): Xaa can be any naturally occurring amino acid
  misc_feature (1570)..(1572): Xaa can be any naturally occurring amino acid
  misc_feature (1574)..(1575): Xaa can be any naturally occurring amino acid
  misc_feature (1577)..(1583): Xaa can be any naturally occurring amino acid
  misc_feature (1585)..(1585): Xaa can be any naturally occurring amino acid
  misc_feature (1588)..(1589): Xaa can be any naturally occurring amino acid
  misc_feature (1591)..(1593): Xaa can be any naturally occurring amino acid
  misc_feature (1596)..(1597): Xaa can be any naturally occurring amino acid
  misc_feature (1606)..(1606): Xaa can be any naturally occurring amino acid
  misc_feature (1610)..(1610): Xaa can be any naturally occurring amino acid
  misc_feature (1612)..(1612): Xaa can be any naturally occurring amino acid
  misc_feature (1614)..(1615): Xaa can be any naturally occurring amino acid
  misc_feature (1617)..(1617): Xaa can be any naturally occurring amino acid
  misc_feature (1619)..(1619): Xaa can be any naturally occurring amino acid
  misc_feature (1628)..(1644): Xaa can be any naturally occurring amino acid
  misc_feature (1646)..(1649): Xaa can be any naturally occurring amino acid
  misc_feature (1657)..(1662): Xaa can be any naturally occurring amino acid
  misc_feature (1665)..(1665): Xaa can be any naturally occurring amino acid
  misc_feature (1668)..(1668): Xaa can be any naturally occurring amino acid
  misc_feature (1670)..(1671): Xaa can be any naturally occurring amino acid
  misc_feature (1674)..(1676): Xaa can be any naturally occurring amino acid
  misc_feature (1678)..(1678): Xaa can be any naturally occurring amino acid
  misc_feature (1680)..(1681): Xaa can be any naturally occurring amino acid
  misc_feature (1683)..(1690): Xaa can be any naturally occurring amino acid
  misc_feature (1693)..(1706): Xaa can be any naturally occurring amino acid
  misc_feature (1710)..(1712): Xaa can be any naturally occurring amino acid
  misc_feature (1714)..(1737): Xaa can be any naturally occurring amino acid
  misc_feature (1739)..(1739): Xaa can be any naturally occurring amino acid
  misc_feature (1741)..(1790): Xaa can be any naturally occurring amino acid
  misc_feature (1792)..(1796): Xaa can be any naturally occurring amino acid
  misc_feature (1798)..(1803): Xaa can be any naturally occurring amino acid
  misc_feature (1805)..(1809): Xaa can be any naturally occurring amino acid
  misc_feature (1812)..(1812): Xaa can be any naturally occurring amino acid
  misc_feature (1814)..(1814): Xaa can be any naturally occurring amino acid
  misc_feature (1816)..(1830): Xaa can be any naturally occurring amino acid
  misc_feature (1832)..(1856): Xaa can be any naturally occurring amino acid
  misc_feature (1858)..(1883): Xaa can be any naturally occurring amino acid
  misc_feature (1886)..(1903): Xaa can be any naturally occurring amino acid
  misc_feature (1905)..(1969): Xaa can be any naturally occurring amino acid
  misc_feature (1971)..(1983): Xaa can be any naturally occurring amino acid
  misc_feature (1985)..(1985): Xaa can be any naturally occurring amino acid
  misc_feature (1987)..(1994): Xaa can be any naturally occurring amino acid
  misc_feature (1996)..(1997): Xaa can be any naturally occurring amino acid
  misc_feature (1999)..(2006): Xaa can be any naturally occurring amino acid
  misc_feature (2008)..(2289): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILXXXXXXXXXGXXXXXXXXXXXXXXXLGXPGXGXXTXLXXXXXXXXXXXXXXXXXXXXXXXXXXXXXXXXXXXXXXYXXXXDXHXPXLXVXXTLXFXXXXXXXXXRXXXXXXXXXXXXXXXXXXXXXXXXXXXXXXXXXXXXXXXXXXXXXXXXXXXXGLXXXXXTXVGXXXXRGXSGGEXKRVXXXEXXXXXXXXXXXXXXDXXTXGLDXXXAXXXXXXLXXXXXXXXXXXXXXXXQXXXXXXXXFDXXXXXXXGXXXXXGXXXXXXXXFXXXGXXCPXRXXXXXXDFLXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXYXXXXXXQXXXXXXRXXXXXXXXXXXXXXXXXXXXXXXXXXXXXFXXXXXXXXXXXXXXXXXXXXXXXXXXXXXXXXXXXXXXXXXXXXXXXXXXXXXXXXXXXKXXXXXXYXXXAXXXXXXXXXXPXXXXXXXXXXXXXYXXXXXXXXXXXXFFXXXLXXXXXXXXXXXXFRXXXXXXXXXXXAXXXXXXXXXXXXXXXGXXXXXXXXXXXXXWXXWXXXXXPXXYXXXXXXXNEFXXXXXXXXXXXXXXXXXXXXXXXXXXXXXXXXXXXXXXXXXXXXXXXXXXXXXXXXXXXXXXXXXXGXXXXXXXXXXXXXXXXXXXXXXWXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXYXXXXXXXXXXXXXXXXXXXXXXXXXXXXXXXXXXXXLXXVXGXXXPGXXTALMGXSGAGKTTLLXXLXXRXXXGXXXXGXXXXXXXXXXGXXXXXXXFXRXXGYXXQXDXHXXXXTVREXLXFSAXLRXXXXXXXXXXXXXXXXXXXXXXXKXXXVXXXIXXLXXXXXXXAXVGXXGXXXGLXXEQRKRLTIXVELXAXPXXLXFXDEPTSGLDXXXXXXXXXXXXXXXXXGXXXXCTIHQPSXXXXXXFDXLLXLXXGGXXXYXGXXGXXXXXXXXYFXXXXXXXXXXXXXXNPAXXXLXXXXXXXXXXXXXXXXXXXXXXXXSXEXXXXXXXXXXXXXXXXXXXXXXXXXXXXXXXXXXXXXXXXXXXXXXXXXXAXXXXXQXXXXXXRXXXXXWRXPXYXXXXXXXXXXXXXXXGXXXXXXXXXXXXXXXXXXXXXXXXXFXXXXXXXXXXXXXXXXXXXXXXXXXXREXXXXXXXXXXXXXXXXXXEXXXXXXXXXXXXXXXXXXXXXXXXXXXXXXXXXXXXXXXXXXXXXXXXXXXXXXXXXXXXXXXXXAXXXXXXXXXXXXXFXGXXXXXXXXPXXWXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94698 - protein, 502 aa, artificial
  consensus sequence
  misc_feature (1)..(45): Xaa can be any naturally occurring amino acid
  misc_feature (47)..(82): Xaa can be any naturally occurring amino acid
  misc_feature (84)..(182): Xaa can be any naturally occurring amino acid
  misc_feature (184)..(186): Xaa can be any naturally occurring amino acid
  misc_feature (189)..(191): Xaa can be any naturally occurring amino acid
  misc_feature (193)..(194): Xaa can be any naturally occurring amino acid
  misc_feature (196)..(199): Xaa can be any naturally occurring amino acid
  misc_feature (201)..(206): Xaa can be any naturally occurring amino acid
  misc_feature (208)..(209): Xaa can be any naturally occurring amino acid
  misc_feature (211)..(214): Xaa can be any naturally occurring amino acid
  misc_feature (216)..(224): Xaa can be any naturally occurring amino acid
  misc_feature (227)..(230): Xaa can be any naturally occurring amino acid
  misc_feature (232)..(234): Xaa can be any naturally occurring amino acid
  misc_feature (237)..(237): Xaa can be any naturally occurring amino acid
  misc_feature (239)..(308): Xaa can be any naturally occurring amino acid
  misc_feature (310)..(312): Xaa can be any naturally occurring amino acid
  misc_feature (314)..(317): Xaa can be any naturally occurring amino acid
  misc_feature (319)..(323): Xaa can be any naturally occurring amino acid
  misc_feature (327)..(327): Xaa can be any naturally occurring amino acid
  misc_feature (330)..(330): Xaa can be any naturally occurring amino acid
  misc_feature (332)..(406): Xaa can be any naturally occurring amino acid
  misc_feature (408)..(410): Xaa can be any naturally occurring amino acid
  misc_feature (412)..(414): Xaa can be any naturally occurring amino acid
  misc_feature (416)..(421): Xaa can be any naturally occurring amino acid
  misc_feature (423)..(429): Xaa can be any naturally occurring amino acid
  misc_feature (431)..(433): Xaa can be any naturally occurring amino acid
  misc_feature (435)..(436): Xaa can be any naturally occurring amino acid
  misc_feature (438)..(441): Xaa can be any naturally occurring amino acid
  misc_feature (443)..(456): Xaa can be any naturally occurring amino acid
  misc_feature (459)..(461): Xaa can be any naturally occurring amino acid
  misc_feature (463)..(464): Xaa can be any naturally occurring amino acid
  misc_feature (466)..(466): Xaa can be any naturally occurring amino acid
  misc_feature (468)..(468): Xaa can be any naturally occurring amino acid
  misc_feature (471)..(476): Xaa can be any naturally occurring amino acid
  misc_feature (479)..(502): Xaa can be any naturally occurring amino acid
XXXXXXXXXXXXXXXXXXXXXXXXXXXXXXXXXXXXXXXXXXXXXLXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXLFXXXDXXPXXXXVXXXXXXLXXWXXXXAXXXXXXXXXREXXXXDXXXDGXVXXXXXXXXXXXXXXXXXXXXXXXXXXXXXXXXXXXXXXXXXXXXXXXXXXXXXXXXXXXXXXXXXXXXXXFXXXDXXXXGXXXXXEFNXFLXPXXXXXXXXXXXXXXXXXXXXXXXXXXXXXXXXXXXXXXXXXXXXXXXXXXXXXXXXXXXXXXXXXXXXXXXXXXXFXXXDXXXDXXXXXXEXXXXXXXLXXXEXXYXXXXAXXXXXXXXXXXXXXADXXXDXXLXLXEMXXXXXXFYXXXXXXXXXXXXXXXXXXXXXXXX

SEQ ID NO: 94699 - protein, 851 aa, artificial
  consensus sequence
  misc_feature (1)..(508): Xaa can be any naturally occurring amino acid
  misc_feature (510)..(512): Xaa can be any naturally occurring amino acid
  misc_feature (514)..(514): Xaa can be any naturally occurring amino acid
  misc_feature (516)..(516): Xaa can be any naturally occurring amino acid
  misc_feature (519)..(523): Xaa can be any naturally occurring amino acid
  misc_feature (525)..(539): Xaa can be any naturally occurring amino acid
  misc_feature (541)..(546): Xaa can be any naturally occurring amino acid
  misc_feature (548)..(579): Xaa can be any naturally occurring amino acid
  misc_feature (581)..(582): Xaa can be any naturally occurring amino acid
  misc_feature (584)..(586): Xaa can be any naturally occurring amino acid
  misc_feature (588)..(851): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXDXDXDGXXXXXEXXXXXXXXXXXXXXXLXXXXXXYXXXXXXXXXXXXXXXXXXXXXXXXXXXXXXXXDXXLXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94700 - protein, 1235 aa, artificial
  consensus sequence
  misc_feature (1)..(327): Xaa can be any naturally occurring amino acid
  misc_feature (329)..(329): Xaa can be any naturally occurring amino acid
  misc_feature (331)..(414): Xaa can be any naturally occurring amino acid
  misc_feature (416)..(463): Xaa can be any naturally occurring amino acid
  misc_feature (465)..(466): Xaa can be any naturally occurring amino acid
  misc_feature (468)..(477): Xaa can be any naturally occurring amino acid
  misc_feature (479)..(497): Xaa can be any naturally occurring amino acid
  misc_feature (499)..(500): Xaa can be any naturally occurring amino acid
  misc_feature (502)..(502): Xaa can be any naturally occurring amino acid
  misc_feature (505)..(506): Xaa can be any naturally occurring amino acid
  misc_feature (508)..(514): Xaa can be any naturally occurring amino acid
  misc_feature (516)..(521): Xaa can be any naturally occurring amino acid
  misc_feature (523)..(524): Xaa can be any naturally occurring amino acid
  misc_feature (526)..(527): Xaa can be any naturally occurring amino acid
  misc_feature (529)..(532): Xaa can be any naturally occurring amino acid
  misc_feature (534)..(536): Xaa can be any naturally occurring amino acid
  misc_feature (539)..(539): Xaa can be any naturally occurring amino acid
  misc_feature (541)..(547): Xaa can be any naturally occurring amino acid
  misc_feature (549)..(549): Xaa can be any naturally occurring amino acid
  misc_feature (551)..(552): Xaa can be any naturally occurring amino acid
  misc_feature (554)..(558): Xaa can be any naturally occurring amino acid
  misc_feature (560)..(562): Xaa can be any naturally occurring amino acid
  misc_feature (564)..(1235): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXPXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXRXXFXXXXXXXXXXFXXXXXXXXXXXXXXXXXXXPXXAXDRXXLXXXXXXXGXXXXXXSXXPXXKXXXXNXXXWSXPXXXXXXXLXGXXWXXXXXKXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94701 - protein, 127 aa, artificial
  consensus sequence
  misc_feature (3)..(27): Xaa can be any naturally occurring amino acid
  misc_feature (29)..(31): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(39): Xaa can be any naturally occurring amino acid
  misc_feature (41)..(41): Xaa can be any naturally occurring amino acid
  misc_feature (43)..(45): Xaa can be any naturally occurring amino acid
  misc_feature (47)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(64): Xaa can be any naturally occurring amino acid
  misc_feature (67)..(68): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(75): Xaa can be any naturally occurring amino acid
  misc_feature (77)..(79): Xaa can be any naturally occurring amino acid
  misc_feature (81)..(82): Xaa can be any naturally occurring amino acid
  misc_feature (85)..(90): Xaa can be any naturally occurring amino acid
  misc_feature (92)..(93): Xaa can be any naturally occurring amino acid
  misc_feature (96)..(97): Xaa can be any naturally occurring amino acid
  misc_feature (99)..(99): Xaa can be any naturally occurring amino acid
  misc_feature (102)..(102): Xaa can be any naturally occurring amino acid
  misc_feature (106)..(106): Xaa can be any naturally occurring amino acid
  misc_feature (109)..(110): Xaa can be any naturally occurring amino acid
  misc_feature (112)..(127): Xaa can be any naturally occurring amino acid
MAXXXXXXXXXXXXXXXXXXXXXXXXXGXXXNAXKXKXXFXQXXXMXGILLXSXRSLXQKXXXXDLXXDXAXLXXEXXXLXXRMXXXXXXLXXEAXXDXSGXFASXLRXXFXXXXXXXXXXXXXXXX

SEQ ID NO: 94702 - protein, 160 aa, artificial
  consensus sequence
  misc_feature (1)..(62): Xaa can be any naturally occurring amino acid
  misc_feature (65)..(70): Xaa can be any naturally occurring amino acid
  misc_feature (73)..(73): Xaa can be any naturally occurring amino acid
  misc_feature (78)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (108)..(108): Xaa can be any naturally occurring amino acid
  misc_feature (120)..(120): Xaa can be any naturally occurring amino acid
  misc_feature (126)..(126): Xaa can be any naturally occurring amino acid
  misc_feature (136)..(136): Xaa can be any naturally occurring amino acid
  misc_feature (138)..(153): Xaa can be any naturally occurring amino acid
XXXXXXXXXXXXXXXXXXXXXXXXXXXXXXXXXXXXXXXXXXXXXXXXXXXXXXXXXXXXXXFNXXXXXXILXEALKXXXXXXXXXXXXXXXXXXXXXXEPXAFXGGXFAGLLRLDLNEXPLKEWXTRTVEASGIXEXXXXXXXXXXXXXXXXPQQIEIE

SEQ ID NO: 94703 - protein, 444 aa, artificial
  consensus sequence
  misc_feature (1)..(207): Xaa can be any naturally occurring amino acid
  misc_feature (209)..(329): Xaa can be any naturally occurring amino acid
  misc_feature (336)..(338): Xaa can be any naturally occurring amino acid
  misc_feature (341)..(341): Xaa can be any naturally occurring amino acid
  misc_feature (346)..(346): Xaa can be any naturally occurring amino acid
  misc_feature (349)..(349): Xaa can be any naturally occurring amino acid
  misc_feature (352)..(352): Xaa can be any naturally occurring amino acid
  misc_feature (371)..(372): Xaa can be any naturally occurring amino acid
  misc_feature (375)..(375): Xaa can be any naturally occurring amino acid
  misc_feature (379)..(380): Xaa can be any naturally occurring amino acid
  misc_feature (389)..(444): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYPNPPDXXXPDXATLRXQWXFAXRQYSRWYSHAWGTAILAGXXFFXLGWXXKGSNPLPSXXXXXXXXXXXXXXXXXXXXXXXXXXXXXXXXXXXXXXXXXXXXXXXXXXXXXXXX

SEQ ID NO: 94704 - protein, 166 aa, artificial
  consensus sequence
  misc_feature (1)..(67): Xaa can be any naturally occurring amino acid
  misc_feature (69)..(82): Xaa can be any naturally occurring amino acid
  misc_feature (84)..(84): Xaa can be any naturally occurring amino acid
  misc_feature (87)..(87): Xaa can be any naturally occurring amino acid
  misc_feature (89)..(89): Xaa can be any naturally occurring amino acid
  misc_feature (92)..(92): Xaa can be any naturally occurring amino acid
  misc_feature (95)..(98): Xaa can be any naturally occurring amino acid
  misc_feature (100)..(101): Xaa can be any naturally occurring amino acid
  misc_feature (103)..(104): Xaa can be any naturally occurring amino acid
  misc_feature (110)..(112): Xaa can be any naturally occurring amino acid
  misc_feature (115)..(115): Xaa can be any naturally occurring amino acid
  misc_feature (118)..(118): Xaa can be any naturally occurring amino acid
  misc_feature (122)..(123): Xaa can be any naturally occurring amino acid
  misc_feature (129)..(129): Xaa can be any naturally occurring amino acid
  misc_feature (131)..(132): Xaa can be any naturally occurring amino acid
  misc_feature (138)..(139): Xaa can be any naturally occurring amino acid
  misc_feature (141)..(143): Xaa can be any naturally occurring amino acid
  misc_feature (146)..(146): Xaa can be any naturally occurring amino acid
  misc_feature (148)..(149): Xaa can be any naturally occurring amino acid
  misc_feature (151)..(154): Xaa can be any naturally occurring amino acid
  misc_feature (160)..(160): Xaa can be any naturally occurring amino acid
  misc_feature (163)..(163): Xaa can be any naturally occurring amino acid
  misc_feature (165)..(166): Xaa can be any naturally occurring amino acid
XXXXXXXXXXXXXXXXXXXXXXXXXXXXXXXXXXXXXXXXXXXXXXXXXXXXXXXXXXXXXXXXXXXMXXXXXXXXXXXXXXRXKAXLXLGXESXXXXSXXGXXLSEQLXXXKEXSMXILKXXITKHNXPXXDVPDEXXEXXXSDXEXXAXXXXNPPKKXKKXKXX

SEQ ID NO: 94705 - protein, 921 aa, artificial
  consensus sequence
  misc_feature (1)..(679): Xaa can be any naturally occurring amino acid
  misc_feature (681)..(712): Xaa can be any naturally occurring amino acid
  misc_feature (714)..(714): Xaa can be any naturally occurring amino acid
  misc_feature (716)..(719): Xaa can be any naturally occurring amino acid
  misc_feature (730)..(731): Xaa can be any naturally occurring amino acid
  misc_feature (734)..(735): Xaa can be any naturally occurring amino acid
  misc_feature (738)..(738): Xaa can be any naturally occurring amino acid
  misc_feature (741)..(741): Xaa can be any naturally occurring amino acid
  misc_feature (743)..(744): Xaa can be any naturally occurring amino acid
  misc_feature (747)..(747): Xaa can be any naturally occurring amino acid
  misc_feature (750)..(750): Xaa can be any naturally occurring amino acid
  misc_feature (755)..(755): Xaa can be any naturally occurring amino acid
  misc_feature (763)..(763): Xaa can be any naturally occurring amino acid
  misc_feature (772)..(775): Xaa can be any naturally occurring amino acid
  misc_feature (778)..(778): Xaa can be any naturally occurring amino acid
  misc_feature (782)..(784): Xaa can be any naturally occurring amino acid
  misc_feature (786)..(786): Xaa can be any naturally occurring amino acid
  misc_feature (788)..(789): Xaa can be any naturally occurring amino acid
  misc_feature (792)..(794): Xaa can be any naturally occurring amino acid
  misc_feature (796)..(797): Xaa can be any naturally occurring amino acid
  misc_feature (799)..(799): Xaa can be any naturally occurring amino acid
  misc_feature (801)..(819): Xaa can be any naturally occurring amino acid
  misc_feature (823)..(823): Xaa can be any naturally occurring amino acid
  misc_feature (825)..(825): Xaa can be any naturally occurring amino acid
  misc_feature (827)..(827): Xaa can be any naturally occurring amino acid
  misc_feature (835)..(836): Xaa can be any naturally occurring amino acid
  misc_feature (838)..(839): Xaa can be any naturally occurring amino acid
  misc_feature (843)..(844): Xaa can be any naturally occurring amino acid
  misc_feature (846)..(846): Xaa can be any naturally occurring amino acid
  misc_feature (849)..(851): Xaa can be any naturally occurring amino acid
  misc_feature (853)..(853): Xaa can be any naturally occurring amino acid
  misc_feature (856)..(856): Xaa can be any naturally occurring amino acid
  misc_feature (861)..(861): Xaa can be any naturally occurring amino acid
  misc_feature (868)..(869): Xaa can be any naturally occurring amino acid
  misc_feature (874)..(878): Xaa can be any naturally occurring amino acid
  misc_feature (881)..(882): Xaa can be any naturally occurring amino acid
  misc_feature (884)..(884): Xaa can be any naturally occurring amino acid
  misc_feature (887)..(892): Xaa can be any naturally occurring amino acid
  misc_feature (895)..(921): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXSXDXXXXRSSRNIAISLXXRYXXVIXRGXGXXNLXEFXSAGVXAYALGCTXEGLRKELMXXXXSGXEIEXXXSXGXXTSXXXKXXSXEXXXXXXXXXXXXXXXXXXXLWLXIXFXTILCTPQXXTXXRWSXXPXVSXXXLXQWXGFCAXIANAYYXXGMAWXXXXXLQXXQXAVXXXXXXPSXXXXXXXXXXXXXXXXXXXXXXXXXXX

SEQ ID NO: 94706 - protein, 612 aa, artificial
  consensus sequence
  misc_feature (1)..(199): Xaa can be any naturally occurring amino acid
  misc_feature (201)..(208): Xaa can be any naturally occurring amino acid
  misc_feature (210)..(230): Xaa can be any naturally occurring amino acid
  misc_feature (232)..(273): Xaa can be any naturally occurring amino acid
  misc_feature (281)..(281): Xaa can be any naturally occurring amino acid
  misc_feature (285)..(285): Xaa can be any naturally occurring amino acid
  misc_feature (289)..(298): Xaa can be any naturally occurring amino acid
  misc_feature (300)..(300): Xaa can be any naturally occurring amino acid
  misc_feature (303)..(305): Xaa can be any naturally occurring amino acid
  misc_feature (309)..(310): Xaa can be any naturally occurring amino acid
  misc_feature (315)..(317): Xaa can be any naturally occurring amino acid
  misc_feature (319)..(321): Xaa can be any naturally occurring amino acid
  misc_feature (325)..(338): Xaa can be any naturally occurring amino acid
  misc_feature (340)..(342): Xaa can be any naturally occurring amino acid
  misc_feature (344)..(378): Xaa can be any naturally occurring amino acid
  misc_feature (380)..(381): Xaa can be any naturally occurring amino acid
  misc_feature (383)..(383): Xaa can be any naturally occurring amino acid
  misc_feature (386)..(395): Xaa can be any naturally occurring amino acid
  misc_feature (397)..(397): Xaa can be any naturally occurring amino acid
  misc_feature (405)..(405): Xaa can be any naturally occurring amino acid
  misc_feature (407)..(408): Xaa can be any naturally occurring amino acid
  misc_feature (411)..(411): Xaa can be any naturally occurring amino acid
  misc_feature (414)..(415): Xaa can be any naturally occurring amino acid
  misc_feature (418)..(465): Xaa can be any naturally occurring amino acid
  misc_feature (467)..(470): Xaa can be any naturally occurring amino acid
  misc_feature (473)..(475): Xaa can be any naturally occurring amino acid
  misc_feature (478)..(481): Xaa can be any naturally occurring amino acid
  misc_feature (484)..(484): Xaa can be any naturally occurring amino acid
  misc_feature (486)..(498): Xaa can be any naturally occurring amino acid
  misc_feature (500)..(500): Xaa can be any naturally occurring amino acid
  misc_feature (502)..(503): Xaa can be any naturally occurring amino acid
  misc_feature (505)..(506): Xaa can be any naturally occurring amino acid
  misc_feature (508)..(539): Xaa can be any naturally occurring amino acid
  misc_feature (541)..(612): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXGXXXXXXXXXXXXXXXXXXXXXPXXXXXXXXXXXXXXXXXXXXXXXXXXXXXXXXXXXXXXXXXXVDVGANVXGMAXFAAXXXXXXXXXXVXAFXXXEPVXXNLQRXXXGXXXNRVXXXXXXXXXXXXXXSXXXGXXXXXXXXXXXXXXXXXXXXXXXXXXXXXXXXXXXVXXIXLDXXXXXXXXXXLXKIDVQGWXEXXVLXGAXXLLXXXXXXXXXXXXXXXXXXXXXXXXXXXXXXXXXXXXXXXXXXXXXXXXEXXXXLLXXXNSXXXXIRXFXXXXXXXXXXXXXLXSXXYXXCXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXX

SEQ ID NO: 94707 - protein, 350 aa, artificial
  consensus sequence
  misc_feature (1)..(95): Xaa can be any naturally occurring amino acid
  misc_feature (97)..(118): Xaa can be any naturally occurring amino acid
  misc_feature (121)..(122): Xaa can be any naturally occurring amino acid
  misc_feature (124)..(128): Xaa can be any naturally occurring amino acid
  misc_feature (130)..(130): Xaa can be any naturally occurring amino acid
  misc_feature (132)..(132): Xaa can be any naturally occurring amino acid
  misc_feature (134)..(134): Xaa can be any naturally occurring amino acid
  misc_feature (137)..(150): Xaa can be any naturally occurring amino acid
  misc_feature (152)..(153): Xaa can be any naturally occurring amino acid
  misc_feature (155)..(156): Xaa can be any naturally occurring amino acid
  misc_feature (158)..(212): Xaa can be any naturally occurring amino acid
  misc_feature (214)..(258): Xaa can be any naturally occurring amino acid
  misc_feature (260)..(261): Xaa can be any naturally occurring amino acid
  misc_feature (263)..(266): Xaa can be any naturally occurring amino acid
  misc_feature (268)..(270): Xaa can be any naturally occurring amino acid
  misc_feature (273)..(275): Xaa can be any naturally occurring amino acid
  misc_feature (279)..(289): Xaa can be any naturally occurring amino acid
  misc_feature (292)..(292): Xaa can be any naturally occurring amino acid
  misc_feature (294)..(295): Xaa can be any naturally occurring amino acid
  misc_feature (298)..(298): Xaa can be any naturally occurring amino acid
  misc_feature (300)..(300): Xaa can be any naturally occurring amino acid
  misc_feature (302)..(302): Xaa can be any naturally occurring amino acid
  misc_feature (306)..(350): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXERXXAXXXXXDXAXAXARXXXXXXXXXXXXXXWXXAXXAXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXRXXVXXXXRXXXLRXXXPGGXXXXXXXXXXXLLXEXXDYXVXLXAQVXXXXXXXXXXXXXXXXXXXXXXXXXXXXXXXXXXXXXXXXXXXXX

SEQ ID NO: 94708 - protein, 1165 aa, artificial
  consensus sequence
  misc_feature (1)..(707): Xaa can be any naturally occurring amino acid
  misc_feature (709)..(721): Xaa can be any naturally occurring amino acid
  misc_feature (723)..(725): Xaa can be any naturally occurring amino acid
  misc_feature (727)..(727): Xaa can be any naturally occurring amino acid
  misc_feature (730)..(730): Xaa can be any naturally occurring amino acid
  misc_feature (732)..(735): Xaa can be any naturally occurring amino acid
  misc_feature (737)..(737): Xaa can be any naturally occurring amino acid
  misc_feature (741)..(741): Xaa can be any naturally occurring amino acid
  misc_feature (744)..(745): Xaa can be any naturally occurring amino acid
  misc_feature (747)..(747): Xaa can be any naturally occurring amino acid
  misc_feature (750)..(751): Xaa can be any naturally occurring amino acid
  misc_feature (753)..(755): Xaa can be any naturally occurring amino acid
  misc_feature (757)..(757): Xaa can be any naturally occurring amino acid
  misc_feature (760)..(760): Xaa can be any naturally occurring amino acid
  misc_feature (766)..(774): Xaa can be any naturally occurring amino acid
  misc_feature (776)..(776): Xaa can be any naturally occurring amino acid
  misc_feature (778)..(778): Xaa can be any naturally occurring amino acid
  misc_feature (782)..(782): Xaa can be any naturally occurring amino acid
  misc_feature (787)..(792): Xaa can be any naturally occurring amino acid
  misc_feature (795)..(795): Xaa can be any naturally occurring amino acid
  misc_feature (798)..(800): Xaa can be any naturally occurring amino acid
  misc_feature (804)..(804): Xaa can be any naturally occurring amino acid
  misc_feature (806)..(806): Xaa can be any naturally occurring amino acid
  misc_feature (808)..(809): Xaa can be any naturally occurring amino acid
  misc_feature (811)..(811): Xaa can be any naturally occurring amino acid
  misc_feature (813)..(815): Xaa can be any naturally occurring amino acid
  misc_feature (819)..(819): Xaa can be any naturally occurring amino acid
  misc_feature (821)..(821): Xaa can be any naturally occurring amino acid
  misc_feature (828)..(828): Xaa can be any naturally occurring amino acid
  misc_feature (831)..(833): Xaa can be any naturally occurring amino acid
  misc_feature (835)..(835): Xaa can be any naturally occurring amino acid
  misc_feature (839)..(839): Xaa can be any naturally occurring amino acid
  misc_feature (843)..(844): Xaa can be any naturally occurring amino acid
  misc_feature (847)..(852): Xaa can be any naturally occurring amino acid
  misc_feature (854)..(854): Xaa can be any naturally occurring amino acid
  misc_feature (857)..(857): Xaa can be any naturally occurring amino acid
  misc_feature (860)..(860): Xaa can be any naturally occurring amino acid
  misc_feature (863)..(863): Xaa can be any naturally occurring amino acid
  misc_feature (867)..(869): Xaa can be any naturally occurring amino acid
  misc_feature (871)..(871): Xaa can be any naturally occurring amino acid
  misc_feature (874)..(875): Xaa can be any naturally occurring amino acid
  misc_feature (881)..(881): Xaa can be any naturally occurring amino acid
  misc_feature (883)..(1010): Xaa can be any naturally occurring amino acid
  misc_feature (1012)..(1012): Xaa can be any naturally occurring amino acid
  misc_feature (1015)..(1016): Xaa can be any naturally occurring amino acid
  misc_feature (1020)..(1021): Xaa can be any naturally occurring amino acid
  misc_feature (1027)..(1027): Xaa can be any naturally occurring amino acid
  misc_feature (1031)..(1031): Xaa can be any naturally occurring amino acid
  misc_feature (1033)..(1165): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXVXXXDXGVXLXXXXHXEVAXVAXXLXKYXXCXXXPXVKXPLIFGXXXXXXXXXWXVXYCSXPTSPXXXXXXGGXYRXXXGRLXFXTXXMXQXXXAPDXVXNKVSFSXFGXXXGXVSLXGKLXXLDXXXXXXWXQVXFEXPEXKVGXXXFXYGXXSEVKLXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXDEXXRLGXXGSRGSXFVFXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94709 - protein, 915 aa, artificial
  consensus sequence
  misc_feature (1)..(518): Xaa can be any naturally occurring amino acid
  misc_feature (521)..(521): Xaa can be any naturally occurring amino acid
  misc_feature (524)..(524): Xaa can be any naturally occurring amino acid
  misc_feature (532)..(532): Xaa can be any naturally occurring amino acid
  misc_feature (536)..(536): Xaa can be any naturally occurring amino acid
  misc_feature (538)..(538): Xaa can be any naturally occurring amino acid
  misc_feature (541)..(542): Xaa can be any naturally occurring amino acid
  misc_feature (544)..(544): Xaa can be any naturally occurring amino acid
  misc_feature (546)..(546): Xaa can be any naturally occurring amino acid
  misc_feature (549)..(555): Xaa can be any naturally occurring amino acid
  misc_feature (557)..(558): Xaa can be any naturally occurring amino acid
  misc_feature (561)..(562): Xaa can be any naturally occurring amino acid
  misc_feature (565)..(566): Xaa can be any naturally occurring amino acid
  misc_feature (569)..(570): Xaa can be any naturally occurring amino acid
  misc_feature (575)..(576): Xaa can be any naturally occurring amino acid
  misc_feature (578)..(579): Xaa can be any naturally occurring amino acid
  misc_feature (581)..(581): Xaa can be any naturally occurring amino acid
  misc_feature (583)..(583): Xaa can be any naturally occurring amino acid
  misc_feature (585)..(589): Xaa can be any naturally occurring amino acid
  misc_feature (594)..(594): Xaa can be any naturally occurring amino acid
  misc_feature (597)..(598): Xaa can be any naturally occurring amino acid
  misc_feature (600)..(600): Xaa can be any naturally occurring amino acid
  misc_feature (602)..(603): Xaa can be any naturally occurring amino acid
  misc_feature (605)..(608): Xaa can be any naturally occurring amino acid
  misc_feature (610)..(610): Xaa can be any naturally occurring amino acid
  misc_feature (613)..(613): Xaa can be any naturally occurring amino acid
  misc_feature (616)..(616): Xaa can be any naturally occurring amino acid
  misc_feature (624)..(628): Xaa can be any naturally occurring amino acid
  misc_feature (630)..(631): Xaa can be any naturally occurring amino acid
  misc_feature (634)..(653): Xaa can be any naturally occurring amino acid
  misc_feature (655)..(656): Xaa can be any naturally occurring amino acid
  misc_feature (659)..(659): Xaa can be any naturally occurring amino acid
  misc_feature (663)..(663): Xaa can be any naturally occurring amino acid
  misc_feature (666)..(726): Xaa can be any naturally occurring amino acid
  misc_feature (731)..(731): Xaa can be any naturally occurring amino acid
  misc_feature (733)..(737): Xaa can be any naturally occurring amino acid
  misc_feature (740)..(740): Xaa can be any naturally occurring amino acid
  misc_feature (742)..(743): Xaa can be any naturally occurring amino acid
  misc_feature (745)..(760): Xaa can be any naturally occurring amino acid
  misc_feature (767)..(767): Xaa can be any naturally occurring amino acid
  misc_feature (770)..(770): Xaa can be any naturally occurring amino acid
  misc_feature (773)..(781): Xaa can be any naturally occurring amino acid
  misc_feature (784)..(785): Xaa can be any naturally occurring amino acid
  misc_feature (789)..(790): Xaa can be any naturally occurring amino acid
  misc_feature (792)..(793): Xaa can be any naturally occurring amino acid
  misc_feature (796)..(799): Xaa can be any naturally occurring amino acid
  misc_feature (803)..(803): Xaa can be any naturally occurring amino acid
  misc_feature (805)..(808): Xaa can be any naturally occurring amino acid
  misc_feature (810)..(816): Xaa can be any naturally occurring amino acid
  misc_feature (818)..(818): Xaa can be any naturally occurring amino acid
  misc_feature (820)..(915): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVYXWDXDETLILLXSLLXGXYAXXFXGXKDXXXXXXXGXXWEXXILXXCDXXFFYEXXEXXNXPXLXXXXXYDDGXDLXXYXFXXDXXXXPXDDXNKXKLAYRHRXXXXXYXXGLXXXXXXXXXXXXXXXXXXXXYXXTDXYTDXWLXXXXXXXXXXXXXXXXXXXXXXXXXXXXXXXXXXXXXXXXXXXXXXXXXXXXXXXXXXXXXVTSGXLXXXXXKCXLXXLXXXXXXXXXXXXXXXXGKLQCFXWIXERXXXXXXXXXFCXXGDGXXEXXAAXXXXWPFXKXXXXPXXXXXXXPXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94710 - protein, 450 aa, artificial
  consensus sequence
  misc_feature (1)..(158): Xaa can be any naturally occurring amino acid
  misc_feature (160)..(205): Xaa can be any naturally occurring amino acid
  misc_feature (207)..(247): Xaa can be any naturally occurring amino acid
  misc_feature (249)..(249): Xaa can be any naturally occurring amino acid
  misc_feature (252)..(281): Xaa can be any naturally occurring amino acid
  misc_feature (283)..(284): Xaa can be any naturally occurring amino acid
  misc_feature (287)..(287): Xaa can be any naturally occurring amino acid
  misc_feature (289)..(292): Xaa can be any naturally occurring amino acid
  misc_feature (295)..(295): Xaa can be any naturally occurring amino acid
  misc_feature (297)..(312): Xaa can be any naturally occurring amino acid
  misc_feature (314)..(315): Xaa can be any naturally occurring amino acid
  misc_feature (324)..(324): Xaa can be any naturally occurring amino acid
  misc_feature (327)..(327): Xaa can be any naturally occurring amino acid
  misc_feature (330)..(330): Xaa can be any naturally occurring amino acid
  misc_feature (334)..(335): Xaa can be any naturally occurring amino acid
  misc_feature (337)..(337): Xaa can be any naturally occurring amino acid
  misc_feature (339)..(339): Xaa can be any naturally occurring amino acid
  misc_feature (343)..(343): Xaa can be any naturally occurring amino acid
  misc_feature (345)..(347): Xaa can be any naturally occurring amino acid
  misc_feature (349)..(352): Xaa can be any naturally occurring amino acid
  misc_feature (354)..(369): Xaa can be any naturally occurring amino acid
  misc_feature (371)..(371): Xaa can be any naturally occurring amino acid
  misc_feature (373)..(375): Xaa can be any naturally occurring amino acid
  misc_feature (383)..(383): Xaa can be any naturally occurring amino acid
  misc_feature (385)..(386): Xaa can be any naturally occurring amino acid
  misc_feature (388)..(388): Xaa can be any naturally occurring amino acid
  misc_feature (395)..(404): Xaa can be any naturally occurring amino acid
  misc_feature (406)..(406): Xaa can be any naturally occurring amino acid
  misc_feature (408)..(409): Xaa can be any naturally occurring amino acid
  misc_feature (411)..(411): Xaa can be any naturally occurring amino acid
  misc_feature (413)..(413): Xaa can be any naturally occurring amino acid
  misc_feature (418)..(418): Xaa can be any naturally occurring amino acid
  misc_feature (421)..(423): Xaa can be any naturally occurring amino acid
  misc_feature (426)..(426): Xaa can be any naturally occurring amino acid
  misc_feature (430)..(431): Xaa can be any naturally occurring amino acid
  misc_feature (433)..(434): Xaa can be any naturally occurring amino acid
  misc_feature (437)..(438): Xaa can be any naturally occurring amino acid
  misc_feature (440)..(440): Xaa can be any naturally occurring amino acid
  misc_feature (443)..(450): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXLXXXXXXXXXXXXXXXXXXXXXXXXXXXXXXXXXXXXXXXXXLXVTXXXXXXXXXXXXXXXXXXXXXXXXXXXXXXVXXAGXDXXXXTWXLXXXXXXXXXXXXXXXXKXXKVKLCYAPXSQXDRXWRKXXDXLXKDKXCXXXIXXXXYXXXXXXXXXXXXXXXXDXPXXXYFVRAYAXDXXGXEVAYGQXXXXXXXXXXFXVXXIXGXHASLXIAXXXFSXFSVXXLXXFFXXEXRKXXXXXXXX

SEQ ID NO: 94711 - protein, 566 aa, artificial
  consensus sequence
  misc_feature (1)..(78): Xaa can be any naturally occurring amino acid
  misc_feature (80)..(150): Xaa can be any naturally occurring amino acid
  misc_feature (152)..(181): Xaa can be any naturally occurring amino acid
  misc_feature (183)..(183): Xaa can be any naturally occurring amino acid
  misc_feature (186)..(186): Xaa can be any naturally occurring amino acid
  misc_feature (191)..(221): Xaa can be any naturally occurring amino acid
  misc_feature (223)..(223): Xaa can be any naturally occurring amino acid
  misc_feature (227)..(227): Xaa can be any naturally occurring amino acid
  misc_feature (229)..(229): Xaa can be any naturally occurring amino acid
  misc_feature (231)..(231): Xaa can be any naturally occurring amino acid
  misc_feature (233)..(233): Xaa can be any naturally occurring amino acid
  misc_feature (235)..(239): Xaa can be any naturally occurring amino acid
  misc_feature (241)..(264): Xaa can be any naturally occurring amino acid
  misc_feature (266)..(266): Xaa can be any naturally occurring amino acid
  misc_feature (268)..(268): Xaa can be any naturally occurring amino acid
  misc_feature (270)..(270): Xaa can be any naturally occurring amino acid
  misc_feature (272)..(276): Xaa can be any naturally occurring amino acid
  misc_feature (278)..(291): Xaa can be any naturally occurring amino acid
  misc_feature (293)..(300): Xaa can be any naturally occurring amino acid
  misc_feature (302)..(346): Xaa can be any naturally occurring amino acid
  misc_feature (348)..(348): Xaa can be any naturally occurring amino acid
  misc_feature (350)..(351): Xaa can be any naturally occurring amino acid
  misc_feature (353)..(355): Xaa can be any naturally occurring amino acid
  misc_feature (357)..(395): Xaa can be any naturally occurring amino acid
  misc_feature (397)..(566): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXTXLYXHGNAXXXXXXXXXXXXXXXXXXXXXXXXXXXXXXXYXGYGXSXGXPXEXXXXXDXXXXXXXXXXXXXXXXXXXXXXXXGXSXGXGXXXXXAXXXXXXXXXXXXXXLXXXXXXXXSXXXXXXXXXXXXXXXXXXXXXXXXXXXXXXXXXXXXXXXXXXXXXPXLXXHXXXDXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94712 - protein, 519 aa, artificial
  consensus sequence
  misc_feature (1)..(168): Xaa can be any naturally occurring amino acid
  misc_feature (170)..(170): Xaa can be any naturally occurring amino acid
  misc_feature (172)..(172): Xaa can be any naturally occurring amino acid
  misc_feature (174)..(175): Xaa can be any naturally occurring amino acid
  misc_feature (178)..(178): Xaa can be any naturally occurring amino acid
  misc_feature (180)..(183): Xaa can be any naturally occurring amino acid
  misc_feature (185)..(186): Xaa can be any naturally occurring amino acid
  misc_feature (190)..(190): Xaa can be any naturally occurring amino acid
  misc_feature (193)..(194): Xaa can be any naturally occurring amino acid
  misc_feature (197)..(200): Xaa can be any naturally occurring amino acid
  misc_feature (202)..(210): Xaa can be any naturally occurring amino acid
  misc_feature (217)..(217): Xaa can be any naturally occurring amino acid
  misc_feature (220)..(230): Xaa can be any naturally occurring amino acid
  misc_feature (234)..(235): Xaa can be any naturally occurring amino acid
  misc_feature (244)..(244): Xaa can be any naturally occurring amino acid
  misc_feature (246)..(330): Xaa can be any naturally occurring amino acid
  misc_feature (333)..(333): Xaa can be any naturally occurring amino acid
  misc_feature (340)..(340): Xaa can be any naturally occurring amino acid
  misc_feature (347)..(347): Xaa can be any naturally occurring amino acid
  misc_feature (349)..(350): Xaa can be any naturally occurring amino acid
  misc_feature (353)..(353): Xaa can be any naturally occurring amino acid
  misc_feature (355)..(357): Xaa can be any naturally occurring amino acid
  misc_feature (360)..(360): Xaa can be any naturally occurring amino acid
  misc_feature (369)..(369): Xaa can be any naturally occurring amino acid
  misc_feature (372)..(372): Xaa can be any naturally occurring amino acid
  misc_feature (374)..(374): Xaa can be any naturally occurring amino acid
  misc_feature (377)..(377): Xaa can be any naturally occurring amino acid
  misc_feature (380)..(380): Xaa can be any naturally occurring amino acid
  misc_feature (384)..(385): Xaa can be any naturally occurring amino acid
  misc_feature (387)..(393): Xaa can be any naturally occurring amino acid
  misc_feature (395)..(399): Xaa can be any naturally occurring amino acid
  misc_feature (402)..(403): Xaa can be any naturally occurring amino acid
  misc_feature (405)..(406): Xaa can be any naturally occurring amino acid
  misc_feature (409)..(410): Xaa can be any naturally occurring amino acid
  misc_feature (412)..(415): Xaa can be any naturally occurring amino acid
  misc_feature (420)..(420): Xaa can be any naturally occurring amino acid
  misc_feature (428)..(429): Xaa can be any naturally occurring amino acid
  misc_feature (435)..(436): Xaa can be any naturally occurring amino acid
  misc_feature (445)..(445): Xaa can be any naturally occurring amino acid
  misc_feature (448)..(448): Xaa can be any naturally occurring amino acid
  misc_feature (453)..(453): Xaa can be any naturally occurring amino acid
  misc_feature (456)..(456): Xaa can be any naturally occurring amino acid
  misc_feature (460)..(462): Xaa can be any naturally occurring amino acid
  misc_feature (464)..(465): Xaa can be any naturally occurring amino acid
  misc_feature (468)..(470): Xaa can be any naturally occurring amino acid
  misc_feature (472)..(519): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXNXVXXPCXDXXXXRXXDGFXFGXXFAXXXXFXXXXXXXXXQLSPCDXRLXXXXXXXXXXXFRPXXVDEISLLTXNXXXXXXXXXXXXXXXXXXXXXXXXXXXXXXXXXXXXXXXXXXXXXXXXXXXXXXXXXXXXXXXXXXXXXXXXXXXXXXXXXXXXXGGXMVAFAGXKYAARSXPXXFVXNXXXTVXSFTLVLEFXKGXLXNLXWKXDGCXXCXXXXXXXCXXXXXCAXXTXXCKXXGXXXXVDCSXGIQLAFSXXGTDKHXXVLNSWYEVXNLXQYSLXGLXSNLXXXLXXQFXXXFXXXXXXXXXXXXXXXXXXXXXXXXXXXXXXXXXXXXXXXXXXXXXXXX

SEQ ID NO: 94713 - protein, 924 aa, artificial
  consensus sequence
  misc_feature (1)..(533): Xaa can be any naturally occurring amino acid
  misc_feature (537)..(544): Xaa can be any naturally occurring amino acid
  misc_feature (546)..(561): Xaa can be any naturally occurring amino acid
  misc_feature (563)..(563): Xaa can be any naturally occurring amino acid
  misc_feature (566)..(746): Xaa can be any naturally occurring amino acid
  misc_feature (753)..(753): Xaa can be any naturally occurring amino acid
  misc_feature (755)..(755): Xaa can be any naturally occurring amino acid
  misc_feature (758)..(759): Xaa can be any naturally occurring amino acid
  misc_feature (761)..(769): Xaa can be any naturally occurring amino acid
  misc_feature (771)..(772): Xaa can be any naturally occurring amino acid
  misc_feature (774)..(775): Xaa can be any naturally occurring amino acid
  misc_feature (778)..(778): Xaa can be any naturally occurring amino acid
  misc_feature (780)..(783): Xaa can be any naturally occurring amino acid
  misc_feature (787)..(791): Xaa can be any naturally occurring amino acid
  misc_feature (793)..(795): Xaa can be any naturally occurring amino acid
  misc_feature (797)..(802): Xaa can be any naturally occurring amino acid
  misc_feature (804)..(809): Xaa can be any naturally occurring amino acid
  misc_feature (813)..(840): Xaa can be any naturally occurring amino acid
  misc_feature (842)..(845): Xaa can be any naturally occurring amino acid
  misc_feature (847)..(852): Xaa can be any naturally occurring amino acid
  misc_feature (854)..(854): Xaa can be any naturally occurring amino acid
  misc_feature (856)..(859): Xaa can be any naturally occurring amino acid
  misc_feature (861)..(863): Xaa can be any naturally occurring amino acid
  misc_feature (865)..(867): Xaa can be any naturally occurring amino acid
  misc_feature (869)..(870): Xaa can be any naturally occurring amino acid
  misc_feature (872)..(924): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVTXXXXXXXXWXXXXXXXXXXXXXXXXLXVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQLCVGXRXCLXXQXXXXXXXXXPXXLXXFLXDXXXXFVGXXXXXDXXXLXXXXXXLXXXXXXDLRXXXXXXXXXXXXXXXXXXXXXXXXXXXXGXXXXKXXXXXXSXWXXXXLXXXQXXXAXXDXXXXXXXXXXXXXXXXXXXXXXXXXXXXXXXXXXXXXXXXXXXXXXXXXXXXX

SEQ ID NO: 94714 - protein, 225 aa, artificial
  consensus sequence
  misc_feature (1)..(15): Xaa can be any naturally occurring amino acid
  misc_feature (17)..(54): Xaa can be any naturally occurring amino acid
  misc_feature (56)..(56): Xaa can be any naturally occurring amino acid
  misc_feature (63)..(93): Xaa can be any naturally occurring amino acid
  misc_feature (95)..(101): Xaa can be any naturally occurring amino acid
  misc_feature (104)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(126): Xaa can be any naturally occurring amino acid
  misc_feature (128)..(128): Xaa can be any naturally occurring amino acid
  misc_feature (130)..(130): Xaa can be any naturally occurring amino acid
  misc_feature (137)..(138): Xaa can be any naturally occurring amino acid
  misc_feature (142)..(143): Xaa can be any naturally occurring amino acid
  misc_feature (145)..(146): Xaa can be any naturally occurring amino acid
  misc_feature (148)..(163): Xaa can be any naturally occurring amino acid
  misc_feature (165)..(195): Xaa can be any naturally occurring amino acid
  misc_feature (197)..(198): Xaa can be any naturally occurring amino acid
  misc_feature (200)..(201): Xaa can be any naturally occurring amino acid
  misc_feature (204)..(204): Xaa can be any naturally occurring amino acid
  misc_feature (208)..(208): Xaa can be any naturally occurring amino acid
  misc_feature (210)..(222): Xaa can be any naturally occurring amino acid
  misc_feature (224)..(225): Xaa can be any naturally occurring amino acid
XXXXXXXXXXXXXXXMXXXXXXXXXXXXXXXXXXXXXXXXXXXXXXXXXXXXXXVXCPKPRRXXXXXXXXXXXXXXXXXXXXXXXXXXXXXXXEXXXXXXXLDXXLXKXGXXXXXXXXXXXXXXXXPXFXGSPPSRXXNPLXXDXXFXXXXXXXXXXXXXXXXPXXXXXXXXXXXXXXXXXXXXXXXXXXXXXXXGXXPXXVRXEGFXCXXXXXXXXXXXXXAXX

SEQ ID NO: 94715 - protein, 510 aa, artificial
  consensus sequence
  misc_feature (1)..(243): Xaa can be any naturally occurring amino acid
  misc_feature (245)..(246): Xaa can be any naturally occurring amino acid
  misc_feature (248)..(249): Xaa can be any naturally occurring amino acid
  misc_feature (251)..(251): Xaa can be any naturally occurring amino acid
  misc_feature (253)..(253): Xaa can be any naturally occurring amino acid
  misc_feature (269)..(270): Xaa can be any naturally occurring amino acid
  misc_feature (290)..(292): Xaa can be any naturally occurring amino acid
  misc_feature (295)..(295): Xaa can be any naturally occurring amino acid
  misc_feature (299)..(299): Xaa can be any naturally occurring amino acid
  misc_feature (302)..(302): Xaa can be any naturally occurring amino acid
  misc_feature (315)..(315): Xaa can be any naturally occurring amino acid
  misc_feature (317)..(317): Xaa can be any naturally occurring amino acid
  misc_feature (319)..(320): Xaa can be any naturally occurring amino acid
  misc_feature (322)..(324): Xaa can be any naturally occurring amino acid
  misc_feature (326)..(327): Xaa can be any naturally occurring amino acid
  misc_feature (329)..(329): Xaa can be any naturally occurring amino acid
  misc_feature (333)..(340): Xaa can be any naturally occurring amino acid
  misc_feature (342)..(363): Xaa can be any naturally occurring amino acid
  misc_feature (365)..(442): Xaa can be any naturally occurring amino acid
  misc_feature (444)..(510): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXGXXRXDXTLLDSSNSDFEFHISXXFDPGDSSPADEIFADGMILXXXPFXVTAXSTXPKRLYKYELPPIXSXPXXSXXXPXXPXPLPXXXXXXXXKXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXX

SEQ ID NO: 94716 - protein, 1018 aa, artificial
  consensus sequence
  misc_feature (1)..(52): Xaa can be any naturally occurring amino acid
  misc_feature (59)..(60): Xaa can be any naturally occurring amino acid
  misc_feature (63)..(64): Xaa can be any naturally occurring amino acid
  misc_feature (68)..(68): Xaa can be any naturally occurring amino acid
  misc_feature (71)..(71): Xaa can be any naturally occurring amino acid
  misc_feature (75)..(76): Xaa can be any naturally occurring amino acid
  misc_feature (78)..(78): Xaa can be any naturally occurring amino acid
  misc_feature (80)..(82): Xaa can be any naturally occurring amino acid
  misc_feature (85)..(101): Xaa can be any naturally occurring amino acid
  misc_feature (103)..(103): Xaa can be any naturally occurring amino acid
  misc_feature (108)..(109): Xaa can be any naturally occurring amino acid
  misc_feature (115)..(116): Xaa can be any naturally occurring amino acid
  misc_feature (118)..(118): Xaa can be any naturally occurring amino acid
  misc_feature (120)..(120): Xaa can be any naturally occurring amino acid
  misc_feature (123)..(124): Xaa can be any naturally occurring amino acid
  misc_feature (127)..(127): Xaa can be any naturally occurring amino acid
  misc_feature (130)..(131): Xaa can be any naturally occurring amino acid
  misc_feature (133)..(133): Xaa can be any naturally occurring amino acid
  misc_feature (136)..(136): Xaa can be any naturally occurring amino acid
  misc_feature (138)..(138): Xaa can be any naturally occurring amino acid
  misc_feature (144)..(144): Xaa can be any naturally occurring amino acid
  misc_feature (147)..(148): Xaa can be any naturally occurring amino acid
  misc_feature (150)..(150): Xaa can be any naturally occurring amino acid
  misc_feature (152)..(175): Xaa can be any naturally occurring amino acid
  misc_feature (177)..(177): Xaa can be any naturally occurring amino acid
  misc_feature (179)..(179): Xaa can be any naturally occurring amino acid
  misc_feature (181)..(182): Xaa can be any naturally occurring amino acid
  misc_feature (184)..(187): Xaa can be any naturally occurring amino acid
  misc_feature (189)..(279): Xaa can be any naturally occurring amino acid
  misc_feature (282)..(282): Xaa can be any naturally occurring amino acid
  misc_feature (284)..(288): Xaa can be any naturally occurring amino acid
  misc_feature (291)..(291): Xaa can be any naturally occurring amino acid
  misc_feature (295)..(295): Xaa can be any naturally occurring amino acid
  misc_feature (298)..(338): Xaa can be any naturally occurring amino acid
  misc_feature (340)..(1018): Xaa can be any naturally occurring amino acid
XXXXXXXXXXXXXXXXXXXXXXXXXXXXXXXXXXXXXXXXXXXXXXXXXXXXSKRRTWXXLFXXVYAXLLXSSWXXLXSXXXWYXXXXXXXXXXXXXXXXXAXYASVXXGAVFGXXSXMXAAXXVAXPAXXVXWIXVXVLLAFXGKXXRXLXXXXXXXXXXXXXXXXXXXXXXXXVXEXRXXTXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXEXXXXXGNXVAAXCAXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94717 - protein, 902 aa, artificial
  consensus sequence
  misc_feature (1)..(482): Xaa can be any naturally occurring amino acid
  misc_feature (485)..(485): Xaa can be any naturally occurring amino acid
  misc_feature (488)..(488): Xaa can be any naturally occurring amino acid
  misc_feature (490)..(490): Xaa can be any naturally occurring amino acid
  misc_feature (496)..(496): Xaa can be any naturally occurring amino acid
  misc_feature (498)..(500): Xaa can be any naturally occurring amino acid
  misc_feature (502)..(503): Xaa can be any naturally occurring amino acid
  misc_feature (505)..(505): Xaa can be any naturally occurring amino acid
  misc_feature (507)..(508): Xaa can be any naturally occurring amino acid
  misc_feature (511)..(514): Xaa can be any naturally occurring amino acid
  misc_feature (516)..(516): Xaa can be any naturally occurring amino acid
  misc_feature (519)..(519): Xaa can be any naturally occurring amino acid
  misc_feature (523)..(523): Xaa can be any naturally occurring amino acid
  misc_feature (526)..(526): Xaa can be any naturally occurring amino acid
  misc_feature (529)..(529): Xaa can be any naturally occurring amino acid
  misc_feature (531)..(542): Xaa can be any naturally occurring amino acid
  misc_feature (544)..(545): Xaa can be any naturally occurring amino acid
  misc_feature (551)..(551): Xaa can be any naturally occurring amino acid
  misc_feature (554)..(557): Xaa can be any naturally occurring amino acid
  misc_feature (561)..(565): Xaa can be any naturally occurring amino acid
  misc_feature (570)..(571): Xaa can be any naturally occurring amino acid
  misc_feature (573)..(574): Xaa can be any naturally occurring amino acid
  misc_feature (578)..(578): Xaa can be any naturally occurring amino acid
  misc_feature (580)..(580): Xaa can be any naturally occurring amino acid
  misc_feature (582)..(583): Xaa can be any naturally occurring amino acid
  misc_feature (585)..(589): Xaa can be any naturally occurring amino acid
  misc_feature (591)..(591): Xaa can be any naturally occurring amino acid
  misc_feature (593)..(593): Xaa can be any naturally occurring amino acid
  misc_feature (596)..(622): Xaa can be any naturally occurring amino acid
  misc_feature (624)..(624): Xaa can be any naturally occurring amino acid
  misc_feature (626)..(626): Xaa can be any naturally occurring amino acid
  misc_feature (628)..(657): Xaa can be any naturally occurring amino acid
  misc_feature (659)..(663): Xaa can be any naturally occurring amino acid
  misc_feature (665)..(666): Xaa can be any naturally occurring amino acid
  misc_feature (668)..(672): Xaa can be any naturally occurring amino acid
  misc_feature (674)..(676): Xaa can be any naturally occurring amino acid
  misc_feature (678)..(678): Xaa can be any naturally occurring amino acid
  misc_feature (680)..(680): Xaa can be any naturally occurring amino acid
  misc_feature (683)..(694): Xaa can be any naturally occurring amino acid
  misc_feature (696)..(697): Xaa can be any naturally occurring amino acid
  misc_feature (701)..(781): Xaa can be any naturally occurring amino acid
  misc_feature (784)..(785): Xaa can be any naturally occurring amino acid
  misc_feature (789)..(789): Xaa can be any naturally occurring amino acid
  misc_feature (794)..(802): Xaa can be any naturally occurring amino acid
  misc_feature (808)..(813): Xaa can be any naturally occurring amino acid
  misc_feature (816)..(816): Xaa can be any naturally occurring amino acid
  misc_feature (818)..(818): Xaa can be any naturally occurring amino acid
  misc_feature (820)..(820): Xaa can be any naturally occurring amino acid
  misc_feature (822)..(822): Xaa can be any naturally occurring amino acid
  misc_feature (824)..(824): Xaa can be any naturally occurring amino acid
  misc_feature (828)..(857): Xaa can be any naturally occurring amino acid
  misc_feature (859)..(859): Xaa can be any naturally occurring amino acid
  misc_feature (861)..(862): Xaa can be any naturally occurring amino acid
  misc_feature (864)..(902): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXWLXLXVFYVRXSXXXVXXSXPXXLTXXXXHXPLXPDTXLEXNGXRXXXXXXXXXXXXSXXLRRDRXVDXXXXEATXXXXXVSTDXXRXXGSVXFXVXXKXXXXXLXGXLEXXXXXXXXXXXXXXXXXXXXXXXXXXXWXMXCXXXXXXXXXXXXXXXXXXXXXXXXXXXXXXPXXXXXYXXGXXXXXPXXXTXTXQLXXXXXXXXXXXXLXXIPEXXXXXXXXXXXXXXXXXXXXXXXXXXXXXXXXXXXXXXXXXXXXXXXXXXXXXXXXXXXXXXXXXXXXXXXXXXXXXXXXXDGXXSWFXAGVRXXXXXXXXXVGVGIXXXXXXLGXCXGXGXGXGLLXXXXXXXXXXXXXXXXXXXXXXXXXXXXXXRXYXXTXXXXXXXXXXXXXXXXXXXXXXXXXXXXXXXXXXXXXXX

SEQ ID NO: 94718 - protein, 789 aa, artificial
  consensus sequence
  misc_feature (1)..(255): Xaa can be any naturally occurring amino acid
  misc_feature (257)..(286): Xaa can be any naturally occurring amino acid
  misc_feature (289)..(289): Xaa can be any naturally occurring amino acid
  misc_feature (291)..(291): Xaa can be any naturally occurring amino acid
  misc_feature (294)..(334): Xaa can be any naturally occurring amino acid
  misc_feature (336)..(338): Xaa can be any naturally occurring amino acid
  misc_feature (340)..(342): Xaa can be any naturally occurring amino acid
  misc_feature (344)..(346): Xaa can be any naturally occurring amino acid
  misc_feature (349)..(363): Xaa can be any naturally occurring amino acid
  misc_feature (365)..(366): Xaa can be any naturally occurring amino acid
  misc_feature (370)..(370): Xaa can be any naturally occurring amino acid
  misc_feature (372)..(376): Xaa can be any naturally occurring amino acid
  misc_feature (378)..(393): Xaa can be any naturally occurring amino acid
  misc_feature (395)..(396): Xaa can be any naturally occurring amino acid
  misc_feature (402)..(406): Xaa can be any naturally occurring amino acid
  misc_feature (408)..(410): Xaa can be any naturally occurring amino acid
  misc_feature (412)..(459): Xaa can be any naturally occurring amino acid
  misc_feature (461)..(470): Xaa can be any naturally occurring amino acid
  misc_feature (472)..(474): Xaa can be any naturally occurring amino acid
  misc_feature (480)..(480): Xaa can be any naturally occurring amino acid
  misc_feature (482)..(485): Xaa can be any naturally occurring amino acid
  misc_feature (487)..(489): Xaa can be any naturally occurring amino acid
  misc_feature (492)..(492): Xaa can be any naturally occurring amino acid
  misc_feature (494)..(511): Xaa can be any naturally occurring amino acid
  misc_feature (513)..(518): Xaa can be any naturally occurring amino acid
  misc_feature (520)..(522): Xaa can be any naturally occurring amino acid
  misc_feature (524)..(532): Xaa can be any naturally occurring amino acid
  misc_feature (535)..(536): Xaa can be any naturally occurring amino acid
  misc_feature (538)..(543): Xaa can be any naturally occurring amino acid
  misc_feature (545)..(545): Xaa can be any naturally occurring amino acid
  misc_feature (550)..(550): Xaa can be any naturally occurring amino acid
  misc_feature (552)..(557): Xaa can be any naturally occurring amino acid
  misc_feature (559)..(588): Xaa can be any naturally occurring amino acid
  misc_feature (592)..(592): Xaa can be any naturally occurring amino acid
  misc_feature (594)..(710): Xaa can be any naturally occurring amino acid
  misc_feature (713)..(716): Xaa can be any naturally occurring amino acid
  misc_feature (718)..(719): Xaa can be any naturally occurring amino acid
  misc_feature (725)..(789): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXXXXXXXXDHXAXRTXXXXXXXXXXXXXXXXXXXXXXXXXXXXXXXXXXXXXXXXXGXXXLXXXFXXXGYXXXXXXXXXXXXXXXFXXKKLXAXXXXXPXXXXXXXXXXXXXXXXPXXFISELXXXXXSXXXQXXXXXXXXXXXXXXXXXXXXXXXXXXXXXXXXXXXXXXXXXXXXXXXXWXXXXXXXXXXLXXXESEYAXWXXXXGXXXNHXTXXXXXXXXXXXXXXXXXXNXXXXXXGXXXNXXXXXXXXXGGXXKXXXXXXLXQSSTXAXXXXXXFXXXXXXXXXXXXXXXXXXXXXXXXXXXXXXEFAXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFXXXXAXXIFESTXXXXXXXXXXXXXXXXXXXXXXXXXXXXXXXXXXXXXXXXXXXXXXXXXXXXXXXXXXXXXXXXX

SEQ ID NO: 94719 - protein, 944 aa, artificial
  consensus sequence
  misc_feature (1)..(120): Xaa can be any naturally occurring amino acid
  misc_feature (123)..(124): Xaa can be any naturally occurring amino acid
  misc_feature (126)..(127): Xaa can be any naturally occurring amino acid
  misc_feature (129)..(131): Xaa can be any naturally occurring amino acid
  misc_feature (133)..(134): Xaa can be any naturally occurring amino acid
  misc_feature (138)..(141): Xaa can be any naturally occurring amino acid
  misc_feature (143)..(143): Xaa can be any naturally occurring amino acid
  misc_feature (146)..(156): Xaa can be any naturally occurring amino acid
  misc_feature (162)..(162): Xaa can be any naturally occurring amino acid
  misc_feature (165)..(166): Xaa can be any naturally occurring amino acid
  misc_feature (168)..(168): Xaa can be any naturally occurring amino acid
  misc_feature (171)..(172): Xaa can be any naturally occurring amino acid
  misc_feature (174)..(175): Xaa can be any naturally occurring amino acid
  misc_feature (177)..(179): Xaa can be any naturally occurring amino acid
  misc_feature (182)..(182): Xaa can be any naturally occurring amino acid
  misc_feature (184)..(185): Xaa can be any naturally occurring amino acid
  misc_feature (187)..(188): Xaa can be any naturally occurring amino acid
  misc_feature (191)..(197): Xaa can be any naturally occurring amino acid
  misc_feature (200)..(205): Xaa can be any naturally occurring amino acid
  misc_feature (207)..(210): Xaa can be any naturally occurring amino acid
  misc_feature (212)..(214): Xaa can be any naturally occurring amino acid
  misc_feature (217)..(218): Xaa can be any naturally occurring amino acid
  misc_feature (221)..(222): Xaa can be any naturally occurring amino acid
  misc_feature (224)..(225): Xaa can be any naturally occurring amino acid
  misc_feature (231)..(233): Xaa can be any naturally occurring amino acid
  misc_feature (235)..(237): Xaa can be any naturally occurring amino acid
  misc_feature (240)..(241): Xaa can be any naturally occurring amino acid
  misc_feature (244)..(245): Xaa can be any naturally occurring amino acid
  misc_feature (249)..(250): Xaa can be any naturally occurring amino acid
  misc_feature (252)..(252): Xaa can be any naturally occurring amino acid
  misc_feature (259)..(259): Xaa can be any naturally occurring amino acid
  misc_feature (261)..(262): Xaa can be any naturally occurring amino acid
  misc_feature (265)..(271): Xaa can be any naturally occurring amino acid
  misc_feature (273)..(274): Xaa can be any naturally occurring amino acid
  misc_feature (277)..(277): Xaa can be any naturally occurring amino acid
  misc_feature (279)..(292): Xaa can be any naturally occurring amino acid
  misc_feature (297)..(298): Xaa can be any naturally occurring amino acid
  misc_feature (300)..(300): Xaa can be any naturally occurring amino acid
  misc_feature (304)..(304): Xaa can be any naturally occurring amino acid
  misc_feature (306)..(307): Xaa can be any naturally occurring amino acid
  misc_feature (310)..(311): Xaa can be any naturally occurring amino acid
  misc_feature (314)..(315): Xaa can be any naturally occurring amino acid
  misc_feature (317)..(320): Xaa can be any naturally occurring amino acid
  misc_feature (322)..(322): Xaa can be any naturally occurring amino acid
  misc_feature (329)..(334): Xaa can be any naturally occurring amino acid
  misc_feature (336)..(339): Xaa can be any naturally occurring amino acid
  misc_feature (342)..(346): Xaa can be any naturally occurring amino acid
  misc_feature (348)..(348): Xaa can be any naturally occurring amino acid
  misc_feature (350)..(351): Xaa can be any naturally occurring amino acid
  misc_feature (353)..(353): Xaa can be any naturally occurring amino acid
  misc_feature (358)..(358): Xaa can be any naturally occurring amino acid
  misc_feature (360)..(360): Xaa can be any naturally occurring amino acid
  misc_feature (362)..(364): Xaa can be any naturally occurring amino acid
  misc_feature (366)..(366): Xaa can be any naturally occurring amino acid
  misc_feature (374)..(377): Xaa can be any naturally occurring amino acid
  misc_feature (380)..(381): Xaa can be any naturally occurring amino acid
  misc_feature (384)..(388): Xaa can be any naturally occurring amino acid
  misc_feature (391)..(412): Xaa can be any naturally occurring amino acid
  misc_feature (414)..(415): Xaa can be any naturally occurring amino acid
  misc_feature (417)..(570): Xaa can be any naturally occurring amino acid
  misc_feature (572)..(944): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEXXLXXAXXXNXXTVIXXXXNXAYXXXXXXXXXXXLDLFLXSFXXGXGTXXLXXHXXXVAXDXXAXXRCXXXXXXXCYXXXXXXTXXXXDXXXEKXXMSXXFXXMMWRRXXXLXXXVLXXGYXXIFTXXDXDVMWLRXPXXRLXXXXXXXDXXISXDXXXXXXXXXXXXXXNTGFXXVXSNNXTXXLFXXWYXXRXXXXGXKEQDVLXXXXXXGXXXXLGXXXXXLXTXXFXGFCQXSXDXXXVXTVHANCCXXXXAKXXDLXXXXXDWXXXXXXXXXXXXXXXXXXXXXXWXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94720 - protein, 435 aa, artificial
  consensus sequence
  misc_feature (1)..(97): Xaa can be any naturally occurring amino acid
  misc_feature (99)..(100): Xaa can be any naturally occurring amino acid
  misc_feature (102)..(103): Xaa can be any naturally occurring amino acid
  misc_feature (106)..(107): Xaa can be any naturally occurring amino acid
  misc_feature (109)..(110): Xaa can be any naturally occurring amino acid
  misc_feature (112)..(131): Xaa can be any naturally occurring amino acid
  misc_feature (133)..(137): Xaa can be any naturally occurring amino acid
  misc_feature (141)..(144): Xaa can be any naturally occurring amino acid
  misc_feature (147)..(149): Xaa can be any naturally occurring amino acid
  misc_feature (152)..(156): Xaa can be any naturally occurring amino acid
  misc_feature (158)..(160): Xaa can be any naturally occurring amino acid
  misc_feature (162)..(162): Xaa can be any naturally occurring amino acid
  misc_feature (164)..(233): Xaa can be any naturally occurring amino acid
  misc_feature (235)..(237): Xaa can be any naturally occurring amino acid
  misc_feature (239)..(239): Xaa can be any naturally occurring amino acid
  misc_feature (241)..(272): Xaa can be any naturally occurring amino acid
  misc_feature (274)..(435): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXEXXEAXXLXXDXXXXXXXXXXXXXXXXXXXXRXXXXXRRKXXXXILXXXLDXXXXXLXXXPXKXXXXXXXXXXXXXXXXXXXXXXXXXXXXXXXXXXXXXXXXXXXXXXXXXXXXXXXXXXXXXXXXXXXXXXNXXXLXGXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94721 - protein, 847 aa, artificial
  consensus sequence
  misc_feature (1)..(771): Xaa can be any naturally occurring amino acid
  misc_feature (775)..(777): Xaa can be any naturally occurring amino acid
  misc_feature (810)..(810): Xaa can be any naturally occurring amino acid
  misc_feature (815)..(815): Xaa can be any naturally occurring amino acid
  misc_feature (819)..(819): Xaa can be any naturally occurring amino acid
  misc_feature (825)..(825): Xaa can be any naturally occurring amino acid
  misc_feature (828)..(832): Xaa can be any naturally occurring amino acid
  misc_feature (834)..(834): Xaa can be any naturally occurring amino acid
  misc_feature (844)..(844): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMSKXXXEKQELPLETSPYTKYEDIEDYKKNAYGTSGHQXVKPGXGGGXTDAPTXSGXXXXXAXPSAIDSANQXAKK

SEQ ID NO: 94722 - protein, 948 aa, artificial
  consensus sequence
  misc_feature (1)..(199): Xaa can be any naturally occurring amino acid
  misc_feature (201)..(205): Xaa can be any naturally occurring amino acid
  misc_feature (207)..(220): Xaa can be any naturally occurring amino acid
  misc_feature (222)..(224): Xaa can be any naturally occurring amino acid
  misc_feature (226)..(228): Xaa can be any naturally occurring amino acid
  misc_feature (230)..(231): Xaa can be any naturally occurring amino acid
  misc_feature (233)..(235): Xaa can be any naturally occurring amino acid
  misc_feature (237)..(247): Xaa can be any naturally occurring amino acid
  misc_feature (250)..(251): Xaa can be any naturally occurring amino acid
  misc_feature (253)..(274): Xaa can be any naturally occurring amino acid
  misc_feature (277)..(284): Xaa can be any naturally occurring amino acid
  misc_feature (286)..(288): Xaa can be any naturally occurring amino acid
  misc_feature (290)..(292): Xaa can be any naturally occurring amino acid
  misc_feature (294)..(294): Xaa can be any naturally occurring amino acid
  misc_feature (296)..(297): Xaa can be any naturally occurring amino acid
  misc_feature (299)..(300): Xaa can be any naturally occurring amino acid
  misc_feature (302)..(302): Xaa can be any naturally occurring amino acid
  misc_feature (304)..(304): Xaa can be any naturally occurring amino acid
  misc_feature (306)..(334): Xaa can be any naturally occurring amino acid
  misc_feature (337)..(341): Xaa can be any naturally occurring amino acid
  misc_feature (349)..(349): Xaa can be any naturally occurring amino acid
  misc_feature (352)..(353): Xaa can be any naturally occurring amino acid
  misc_feature (357)..(358): Xaa can be any naturally occurring amino acid
  misc_feature (360)..(360): Xaa can be any naturally occurring amino acid
  misc_feature (364)..(365): Xaa can be any naturally occurring amino acid
  misc_feature (368)..(368): Xaa can be any naturally occurring amino acid
  misc_feature (370)..(948): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXLXXXXXXXXXXXXXXIXXXAXXXKXXFXXXRXXXXXXXXXXXNRXXEXXXXXXXXXXXXXXXXXXXXXXQEXXXXXXXXFXXXAXXXYXWXXIXXLXPXEXXXXXXXXXXXXXXXXXXXXXXXXXXXXXKPXXXXXQGPKPGKXTDXXRMRXXLXKLKXXPPXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94723 - protein, 126 aa, artificial
  consensus sequence
  misc_feature (6)..(6): Xaa can be any naturally occurring amino acid
  misc_feature (8)..(8): Xaa can be any naturally occurring amino acid
  misc_feature (10)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(25): Xaa can be any naturally occurring amino acid
  misc_feature (27)..(30): Xaa can be any naturally occurring amino acid
  misc_feature (32)..(43): Xaa can be any naturally occurring amino acid
  misc_feature (46)..(50): Xaa can be any naturally occurring amino acid
  misc_feature (52)..(66): Xaa can be any naturally occurring amino acid
  misc_feature (68)..(68): Xaa can be any naturally occurring amino acid
  misc_feature (71)..(73): Xaa can be any naturally occurring amino acid
  misc_feature (78)..(79): Xaa can be any naturally occurring amino acid
  misc_feature (82)..(83): Xaa can be any naturally occurring amino acid
  misc_feature (85)..(85): Xaa can be any naturally occurring amino acid
  misc_feature (87)..(88): Xaa can be any naturally occurring amino acid
  misc_feature (90)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(118): Xaa can be any naturally occurring amino acid
  misc_feature (120)..(120): Xaa can be any naturally occurring amino acid
  misc_feature (126)..(126): Xaa can be any naturally occurring amino acid
MGNCLXHXSXXXXXXGXDXDXXXXXFXXXXEXXXXXXXXXXXXTTXXXXXKXXXXXXXXXXXXXXXEXKIXXXKKQLXXLLXXVXVXXLXXXXXXXXXXXXXXXXXXXXXXXRXWXPXLXSIPEVX

SEQ ID NO: 94724 - protein, 551 aa, artificial
  consensus sequence
  misc_feature (1)..(120): Xaa can be any naturally occurring amino acid
  misc_feature (122)..(124): Xaa can be any naturally occurring amino acid
  misc_feature (127)..(181): Xaa can be any naturally occurring amino acid
  misc_feature (183)..(187): Xaa can be any naturally occurring amino acid
  misc_feature (189)..(194): Xaa can be any naturally occurring amino acid
  misc_feature (196)..(199): Xaa can be any naturally occurring amino acid
  misc_feature (201)..(209): Xaa can be any naturally occurring amino acid
  misc_feature (211)..(213): Xaa can be any naturally occurring amino acid
  misc_feature (215)..(215): Xaa can be any naturally occurring amino acid
  misc_feature (217)..(221): Xaa can be any naturally occurring amino acid
  misc_feature (224)..(234): Xaa can be any naturally occurring amino acid
  misc_feature (236)..(239): Xaa can be any naturally occurring amino acid
  misc_feature (249)..(343): Xaa can be any naturally occurring amino acid
  misc_feature (345)..(345): Xaa can be any naturally occurring amino acid
  misc_feature (347)..(347): Xaa can be any naturally occurring amino acid
  misc_feature (349)..(351): Xaa can be any naturally occurring amino acid
  misc_feature (353)..(355): Xaa can be any naturally occurring amino acid
  misc_feature (361)..(365): Xaa can be any naturally occurring amino acid
  misc_feature (368)..(369): Xaa can be any naturally occurring amino acid
  misc_feature (371)..(378): Xaa can be any naturally occurring amino acid
  misc_feature (380)..(381): Xaa can be any naturally occurring amino acid
  misc_feature (383)..(384): Xaa can be any naturally occurring amino acid
  misc_feature (386)..(386): Xaa can be any naturally occurring amino acid
  misc_feature (390)..(391): Xaa can be any naturally occurring amino acid
  misc_feature (393)..(398): Xaa can be any naturally occurring amino acid
  misc_feature (400)..(400): Xaa can be any naturally occurring amino acid
  misc_feature (402)..(403): Xaa can be any naturally occurring amino acid
  misc_feature (405)..(407): Xaa can be any naturally occurring amino acid
  misc_feature (409)..(410): Xaa can be any naturally occurring amino acid
  misc_feature (412)..(417): Xaa can be any naturally occurring amino acid
  misc_feature (419)..(434): Xaa can be any naturally occurring amino acid
  misc_feature (438)..(439): Xaa can be any naturally occurring amino acid
  misc_feature (442)..(442): Xaa can be any naturally occurring amino acid
  misc_feature (447)..(449): Xaa can be any naturally occurring amino acid
  misc_feature (452)..(452): Xaa can be any naturally occurring amino acid
  misc_feature (454)..(454): Xaa can be any naturally occurring amino acid
  misc_feature (456)..(458): Xaa can be any naturally occurring amino acid
  misc_feature (460)..(475): Xaa can be any naturally occurring amino acid
  misc_feature (477)..(477): Xaa can be any naturally occurring amino acid
  misc_feature (481)..(481): Xaa can be any naturally occurring amino acid
  misc_feature (483)..(483): Xaa can be any naturally occurring amino acid
  misc_feature (485)..(488): Xaa can be any naturally occurring amino acid
  misc_feature (490)..(501): Xaa can be any naturally occurring amino acid
  misc_feature (505)..(505): Xaa can be any naturally occurring amino acid
  misc_feature (507)..(507): Xaa can be any naturally occurring amino acid
  misc_feature (510)..(551): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXFLXXXXXXXXXXXXXXXXXXXXXXXXXXXXXXXXXXXXXXXXXXXXXXXXXXXXXXXGXXXXXGXXXXXXSXXXXCXXXXXXXXXLXXXMXYXXXXXCPXXXXXXXXXXXLXXXXCEPLPRRRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXGXDXXXGXXXFAARMXXXXXVTXXTXXXXXXXXPXXEXXAXRGLXXLXXXXXXRXPXXDXXXDXXHXXXXXXLXXXXXXXXXXXXXXXXLEFXXFDXDRVLXXXGLXWXDXXXCXXXXXXXXXXXXXXXXRXGYKXLXWXXXXKXXXXXXXXXXXXLSAXLXKPXXXXXXXXXXXXXXXXXXXXXXXXXXXXXXXXXXXXXXXXXX

SEQ ID NO: 94725 - protein, 187 aa, artificial
  consensus sequence
  misc_feature (1)..(1): Xaa can be any naturally occurring amino acid
  misc_feature (6)..(6): Xaa can be any naturally occurring amino acid
  misc_feature (10)..(10): Xaa can be any naturally occurring amino acid
  misc_feature (17)..(17): Xaa can be any naturally occurring amino acid
  misc_feature (19)..(19): Xaa can be any naturally occurring amino acid
  misc_feature (29)..(35): Xaa can be any naturally occurring amino acid
  misc_feature (37)..(38): Xaa can be any naturally occurring amino acid
  misc_feature (40)..(41): Xaa can be any naturally occurring amino acid
  misc_feature (47)..(47): Xaa can be any naturally occurring amino acid
  misc_feature (51)..(52): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(74): Xaa can be any naturally occurring amino acid
  misc_feature (79)..(79): Xaa can be any naturally occurring amino acid
  misc_feature (81)..(86): Xaa can be any naturally occurring amino acid
  misc_feature (88)..(89): Xaa can be any naturally occurring amino acid
  misc_feature (98)..(99): Xaa can be any naturally occurring amino acid
  misc_feature (104)..(104): Xaa can be any naturally occurring amino acid
  misc_feature (106)..(106): Xaa can be any naturally occurring amino acid
  misc_feature (109)..(109): Xaa can be any naturally occurring amino acid
  misc_feature (112)..(113): Xaa can be any naturally occurring amino acid
  misc_feature (121)..(121): Xaa can be any naturally occurring amino acid
  misc_feature (130)..(130): Xaa can be any naturally occurring amino acid
  misc_feature (133)..(133): Xaa can be any naturally occurring amino acid
  misc_feature (136)..(136): Xaa can be any naturally occurring amino acid
  misc_feature (169)..(169): Xaa can be any naturally occurring amino acid
  misc_feature (171)..(174): Xaa can be any naturally occurring amino acid
  misc_feature (176)..(176): Xaa can be any naturally occurring amino acid
  misc_feature (185)..(185): Xaa can be any naturally occurring amino acid
XMKPTXKSIXRVGRFLXKXLGSIKSTICXXXXXXXPXXNXXPLLSPXSCSXXRXCPXDSXXQTXEXYXVXXXXXTAVAXTXXXXXXNXXQHKKKPKKXXVAEPXEXAKXRGXXLAQKMKDXNMVDLRDVXHAXDVXEALRCYSSIRSPVYLDIVDNFFTDMYYEFSDPXTXXXXIXGSRRKAGSXRL

SEQ ID NO: 94726 - protein, 568 aa, artificial
  consensus sequence
  misc_feature (1)..(257): Xaa can be any naturally occurring amino acid
  misc_feature (260)..(260): Xaa can be any naturally occurring amino acid
  misc_feature (269)..(269): Xaa can be any naturally occurring amino acid
  misc_feature (272)..(274): Xaa can be any naturally occurring amino acid
  misc_feature (276)..(276): Xaa can be any naturally occurring amino acid
  misc_feature (278)..(278): Xaa can be any naturally occurring amino acid
  misc_feature (280)..(327): Xaa can be any naturally occurring amino acid
  misc_feature (334)..(334): Xaa can be any naturally occurring amino acid
  misc_feature (336)..(336): Xaa can be any naturally occurring amino acid
  misc_feature (338)..(338): Xaa can be any naturally occurring amino acid
  misc_feature (341)..(342): Xaa can be any naturally occurring amino acid
  misc_feature (352)..(352): Xaa can be any naturally occurring amino acid
  misc_feature (356)..(356): Xaa can be any naturally occurring amino acid
  misc_feature (358)..(358): Xaa can be any naturally occurring amino acid
  misc_feature (360)..(360): Xaa can be any naturally occurring amino acid
  misc_feature (362)..(371): Xaa can be any naturally occurring amino acid
  misc_feature (373)..(375): Xaa can be any naturally occurring amino acid
  misc_feature (378)..(384): Xaa can be any naturally occurring amino acid
  misc_feature (386)..(386): Xaa can be any naturally occurring amino acid
  misc_feature (388)..(390): Xaa can be any naturally occurring amino acid
  misc_feature (392)..(409): Xaa can be any naturally occurring amino acid
  misc_feature (411)..(411): Xaa can be any naturally occurring amino acid
  misc_feature (413)..(415): Xaa can be any naturally occurring amino acid
  misc_feature (417)..(419): Xaa can be any naturally occurring amino acid
  misc_feature (421)..(421): Xaa can be any naturally occurring amino acid
  misc_feature (423)..(444): Xaa can be any naturally occurring amino acid
  misc_feature (446)..(454): Xaa can be any naturally occurring amino acid
  misc_feature (456)..(456): Xaa can be any naturally occurring amino acid
  misc_feature (459)..(459): Xaa can be any naturally occurring amino acid
  misc_feature (461)..(461): Xaa can be any naturally occurring amino acid
  misc_feature (463)..(464): Xaa can be any naturally occurring amino acid
  misc_feature (466)..(468): Xaa can be any naturally occurring amino acid
  misc_feature (470)..(470): Xaa can be any naturally occurring amino acid
  misc_feature (473)..(473): Xaa can be any naturally occurring amino acid
  misc_feature (475)..(479): Xaa can be any naturally occurring amino acid
  misc_feature (482)..(505): Xaa can be any naturally occurring amino acid
  misc_feature (508)..(509): Xaa can be any naturally occurring amino acid
  misc_feature (511)..(511): Xaa can be any naturally occurring amino acid
  misc_feature (513)..(520): Xaa can be any naturally occurring amino acid
  misc_feature (524)..(540): Xaa can be any naturally occurring amino acid
  misc_feature (544)..(547): Xaa can be any naturally occurring amino acid
  misc_feature (549)..(550): Xaa can be any naturally occurring amino acid
  misc_feature (562)..(562): Xaa can be any naturally occurring amino acid
  misc_feature (564)..(564): Xaa can be any naturally occurring amino acid
  misc_feature (567)..(567): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMPXGAKKRKALXKKXXXQXAXGXXXXXXXXXXXXXXXXXXXXXXXXXXXXXXXXXXXXXXXXXXXXXXXXDEHGSQXDXRXSDXXLSSPGSQGNXEFGXTXDXSXXXXXXXXXXKXXXKEXXXXXXXTXGXXXKXXXXXXXXXXXXXXXXXXVXKXXXSXXXNXTXXXXXXXXXXXXXXXXXXXXXXPXXXXXXXXXSXSKXVXSXXSXXXEXSTXSXXXXXKSXXXXXXXXXXXXXXXXXXXXXXXXSAXXTXKXXXXXXXXEVPXXXXXXXXXXXXXXXXXLLPXXXXVXXTSWLSCCGLFDXMXGSXR

SEQ ID NO: 94727 - protein, 204 aa, artificial
  consensus sequence
  misc_feature (1)..(38): Xaa can be any naturally occurring amino acid
  misc_feature (40)..(42): Xaa can be any naturally occurring amino acid
  misc_feature (44)..(52): Xaa can be any naturally occurring amino acid
  misc_feature (54)..(67): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (101)..(102): Xaa can be any naturally occurring amino acid
  misc_feature (110)..(110): Xaa can be any naturally occurring amino acid
  misc_feature (114)..(114): Xaa can be any naturally occurring amino acid
  misc_feature (121)..(121): Xaa can be any naturally occurring amino acid
  misc_feature (123)..(123): Xaa can be any naturally occurring amino acid
  misc_feature (135)..(135): Xaa can be any naturally occurring amino acid
  misc_feature (140)..(140): Xaa can be any naturally occurring amino acid
  misc_feature (143)..(145): Xaa can be any naturally occurring amino acid
  misc_feature (148)..(148): Xaa can be any naturally occurring amino acid
  misc_feature (150)..(152): Xaa can be any naturally occurring amino acid
  misc_feature (155)..(155): Xaa can be any naturally occurring amino acid
  misc_feature (161)..(161): Xaa can be any naturally occurring amino acid
  misc_feature (163)..(204): Xaa can be any naturally occurring amino acid
XXXXXXXXXXXXXXXXXXXXXXXXXXXXXXXXXXXXXXGXXXGXXXXXXXXXAXXXXXXXXXXXXXXRHFSXKRXVDXRRINPKVPKEEAVAISGRLLQIXXDHGPLTVXNTWXNHAKDAXIXGLNSKTHMKILXLKWMXGRXXXKLXCXXXGNXKKFLYXPXXXXXXXXXXXXXXXXXXXXXXXXXXXXXXXXXXXXXXXXXX

SEQ ID NO: 94728 - protein, 1495 aa, artificial
  consensus sequence
  misc_feature (1)..(101): Xaa can be any naturally occurring amino acid
  misc_feature (104)..(105): Xaa can be any naturally occurring amino acid
  misc_feature (107)..(108): Xaa can be any naturally occurring amino acid
  misc_feature (110)..(115): Xaa can be any naturally occurring amino acid
  misc_feature (117)..(120): Xaa can be any naturally occurring amino acid
  misc_feature (123)..(124): Xaa can be any naturally occurring amino acid
  misc_feature (126)..(126): Xaa can be any naturally occurring amino acid
  misc_feature (131)..(132): Xaa can be any naturally occurring amino acid
  misc_feature (136)..(137): Xaa can be any naturally occurring amino acid
  misc_feature (144)..(149): Xaa can be any naturally occurring amino acid
  misc_feature (151)..(151): Xaa can be any naturally occurring amino acid
  misc_feature (153)..(154): Xaa can be any naturally occurring amino acid
  misc_feature (160)..(160): Xaa can be any naturally occurring amino acid
  misc_feature (162)..(165): Xaa can be any naturally occurring amino acid
  misc_feature (168)..(168): Xaa can be any naturally occurring amino acid
  misc_feature (170)..(171): Xaa can be any naturally occurring amino acid
  misc_feature (173)..(177): Xaa can be any naturally occurring amino acid
  misc_feature (179)..(181): Xaa can be any naturally occurring amino acid
  misc_feature (183)..(183): Xaa can be any naturally occurring amino acid
  misc_feature (185)..(186): Xaa can be any naturally occurring amino acid
  misc_feature (188)..(188): Xaa can be any naturally occurring amino acid
  misc_feature (190)..(190): Xaa can be any naturally occurring amino acid
  misc_feature (194)..(196): Xaa can be any naturally occurring amino acid
  misc_feature (199)..(199): Xaa can be any naturally occurring amino acid
  misc_feature (201)..(201): Xaa can be any naturally occurring amino acid
  misc_feature (204)..(205): Xaa can be any naturally occurring amino acid
  misc_feature (209)..(215): Xaa can be any naturally occurring amino acid
  misc_feature (217)..(218): Xaa can be any naturally occurring amino acid
  misc_feature (223)..(223): Xaa can be any naturally occurring amino acid
  misc_feature (227)..(258): Xaa can be any naturally occurring amino acid
  misc_feature (260)..(275): Xaa can be any naturally occurring amino acid
  misc_feature (277)..(279): Xaa can be any naturally occurring amino acid
  misc_feature (281)..(283): Xaa can be any naturally occurring amino acid
  misc_feature (286)..(287): Xaa can be any naturally occurring amino acid
  misc_feature (289)..(292): Xaa can be any naturally occurring amino acid
  misc_feature (294)..(298): Xaa can be any naturally occurring amino acid
  misc_feature (300)..(303): Xaa can be any naturally occurring amino acid
  misc_feature (306)..(306): Xaa can be any naturally occurring amino acid
  misc_feature (309)..(322): Xaa can be any naturally occurring amino acid
  misc_feature (324)..(326): Xaa can be any naturally occurring amino acid
  misc_feature (328)..(330): Xaa can be any naturally occurring amino acid
  misc_feature (332)..(332): Xaa can be any naturally occurring amino acid
  misc_feature (335)..(336): Xaa can be any naturally occurring amino acid
  misc_feature (338)..(343): Xaa can be any naturally occurring amino acid
  misc_feature (345)..(346): Xaa can be any naturally occurring amino acid
  misc_feature (349)..(350): Xaa can be any naturally occurring amino acid
  misc_feature (353)..(353): Xaa can be any naturally occurring amino acid
  misc_feature (356)..(1495): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWXXGXXPXXXXXXEXXXXYFXXLXGFLLXXHGSXXGAGPTLXXXXXXSXKXXVDSSFXLXXXXVSXYXXSXXXXXKXXXIXQXXGXVXEACXXXKKXPXTNXXAIGXXXXXXXVXXKDVLXEMKXXXXXXXXXXXXXXXXXXXXXXXXXXXXXXXXSXXXXXXXXXXXXXXXXDXXXEXXXVAXXVXXXXVXXXXXVXXXXIRXITXXXXXXXXXXXXXXNXXXVXXXEXLLXXCXXXXXXIXXLGXXVYXPPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94729 - protein, 1009 aa, artificial
  consensus sequence
  misc_feature (1)..(362): Xaa can be any naturally occurring amino acid
  misc_feature (364)..(365): Xaa can be any naturally occurring amino acid
  misc_feature (367)..(447): Xaa can be any naturally occurring amino acid
  misc_feature (449)..(449): Xaa can be any naturally occurring amino acid
  misc_feature (451)..(451): Xaa can be any naturally occurring amino acid
  misc_feature (453)..(460): Xaa can be any naturally occurring amino acid
  misc_feature (462)..(489): Xaa can be any naturally occurring amino acid
  misc_feature (492)..(495): Xaa can be any naturally occurring amino acid
  misc_feature (497)..(497): Xaa can be any naturally occurring amino acid
  misc_feature (500)..(501): Xaa can be any naturally occurring amino acid
  misc_feature (503)..(503): Xaa can be any naturally occurring amino acid
  misc_feature (506)..(506): Xaa can be any naturally occurring amino acid
  misc_feature (511)..(519): Xaa can be any naturally occurring amino acid
  misc_feature (524)..(547): Xaa can be any naturally occurring amino acid
  misc_feature (549)..(552): Xaa can be any naturally occurring amino acid
  misc_feature (554)..(554): Xaa can be any naturally occurring amino acid
  misc_feature (556)..(558): Xaa can be any naturally occurring amino acid
  misc_feature (561)..(562): Xaa can be any naturally occurring amino acid
  misc_feature (565)..(565): Xaa can be any naturally occurring amino acid
  misc_feature (567)..(568): Xaa can be any naturally occurring amino acid
  misc_feature (571)..(571): Xaa can be any naturally occurring amino acid
  misc_feature (577)..(583): Xaa can be any naturally occurring amino acid
  misc_feature (585)..(587): Xaa can be any naturally occurring amino acid
  misc_feature (589)..(590): Xaa can be any naturally occurring amino acid
  misc_feature (592)..(593): Xaa can be any naturally occurring amino acid
  misc_feature (595)..(595): Xaa can be any naturally occurring amino acid
  misc_feature (597)..(599): Xaa can be any naturally occurring amino acid
  misc_feature (601)..(603): Xaa can be any naturally occurring amino acid
  misc_feature (606)..(611): Xaa can be any naturally occurring amino acid
  misc_feature (613)..(614): Xaa can be any naturally occurring amino acid
  misc_feature (617)..(620): Xaa can be any naturally occurring amino acid
  misc_feature (622)..(624): Xaa can be any naturally occurring amino acid
  misc_feature (626)..(626): Xaa can be any naturally occurring amino acid
  misc_feature (629)..(629): Xaa can be any naturally occurring amino acid
  misc_feature (633)..(645): Xaa can be any naturally occurring amino acid
  misc_feature (647)..(648): Xaa can be any naturally occurring amino acid
  misc_feature (651)..(651): Xaa can be any naturally occurring amino acid
  misc_feature (656)..(659): Xaa can be any naturally occurring amino acid
  misc_feature (662)..(663): Xaa can be any naturally occurring amino acid
  misc_feature (665)..(675): Xaa can be any naturally occurring amino acid
  misc_feature (677)..(678): Xaa can be any naturally occurring amino acid
  misc_feature (680)..(700): Xaa can be any naturally occurring amino acid
  misc_feature (702)..(707): Xaa can be any naturally occurring amino acid
  misc_feature (709)..(711): Xaa can be any naturally occurring amino acid
  misc_feature (713)..(713): Xaa can be any naturally occurring amino acid
  misc_feature (716)..(732): Xaa can be any naturally occurring amino acid
  misc_feature (734)..(739): Xaa can be any naturally occurring amino acid
  misc_feature (741)..(744): Xaa can be any naturally occurring amino acid
  misc_feature (746)..(747): Xaa can be any naturally occurring amino acid
  misc_feature (749)..(749): Xaa can be any naturally occurring amino acid
  misc_feature (753)..(753): Xaa can be any naturally occurring amino acid
  misc_feature (756)..(756): Xaa can be any naturally occurring amino acid
  misc_feature (759)..(772): Xaa can be any naturally occurring amino acid
  misc_feature (775)..(776): Xaa can be any naturally occurring amino acid
  misc_feature (778)..(783): Xaa can be any naturally occurring amino acid
  misc_feature (786)..(1009): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXCXXXXXXXXXXXXXXXXXXXXXXXXXXXXXXXXXXXXXXXXXXXXXXXXXXXXXXXXXXXXXXXXXXXXXXXXXXXXXXXXXPXNXYXXXXXXXXNXXXXXXXXXXXXXXXXXXXXXXXXXXXXNQXXXXTXQLXXGXVRXLMLDXXXXXXXXXLCHSXXXXXXXXXXXXXXXXXXXXXXXXPXXXXLXEXXXFLXXNPXEXXTIXIEDYVXXXXXXXLXXXFXXAXXLXKXXXPXXXMPXXXXXXGXXWPXXXXMXXXNXRLXVFTXXXXXXXXXXXXXEXXEGXAYQWXXXXENXXGXXXXXXXXXXXCXXRXXXXXXXXXXXXXXXXXXXXXLXXXXXXLXXXNXFPXXXXXXXXXXXXXXXXXLXXXXXXCXXXXGXXRXPNFXAVXFYXXXXXXXXXXXXXXGGXXFXXXXXXNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94730 - protein, 1251 aa, artificial
  consensus sequence
  misc_feature (1)..(705): Xaa can be any naturally occurring amino acid
  misc_feature (707)..(709): Xaa can be any naturally occurring amino acid
  misc_feature (711)..(729): Xaa can be any naturally occurring amino acid
  misc_feature (731)..(736): Xaa can be any naturally occurring amino acid
  misc_feature (738)..(747): Xaa can be any naturally occurring amino acid
  misc_feature (749)..(751): Xaa can be any naturally occurring amino acid
  misc_feature (753)..(982): Xaa can be any naturally occurring amino acid
  misc_feature (985)..(985): Xaa can be any naturally occurring amino acid
  misc_feature (987)..(987): Xaa can be any naturally occurring amino acid
  misc_feature (989)..(989): Xaa can be any naturally occurring amino acid
  misc_feature (991)..(992): Xaa can be any naturally occurring amino acid
  misc_feature (994)..(1020): Xaa can be any naturally occurring amino acid
  misc_feature (1022)..(1024): Xaa can be any naturally occurring amino acid
  misc_feature (1026)..(1027): Xaa can be any naturally occurring amino acid
  misc_feature (1029)..(1029): Xaa can be any naturally occurring amino acid
  misc_feature (1031)..(1031): Xaa can be any naturally occurring amino acid
  misc_feature (1033)..(1033): Xaa can be any naturally occurring amino acid
  misc_feature (1035)..(1037): Xaa can be any naturally occurring amino acid
  misc_feature (1039)..(1041): Xaa can be any naturally occurring amino acid
  misc_feature (1044)..(1049): Xaa can be any naturally occurring amino acid
  misc_feature (1051)..(1062): Xaa can be any naturally occurring amino acid
  misc_feature (1064)..(1066): Xaa can be any naturally occurring amino acid
  misc_feature (1068)..(1081): Xaa can be any naturally occurring amino acid
  misc_feature (1083)..(1125): Xaa can be any naturally occurring amino acid
  misc_feature (1127)..(1130): Xaa can be any naturally occurring amino acid
  misc_feature (1134)..(1134): Xaa can be any naturally occurring amino acid
  misc_feature (1136)..(1166): Xaa can be any naturally occurring amino acid
  misc_feature (1168)..(1211): Xaa can be any naturally occurring amino acid
  misc_feature (1213)..(1223): Xaa can be any naturally occurring amino acid
  misc_feature (1226)..(1251): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXRXXXXXXXXXXXXXXXXXXXRXXXXXXDXXXXXXXXXXGXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGXFXDXRXXRXXXXXXXXXXXXXXXXXXXXXXXXXXXGXXXLXXFXYXGXFXXXAXXXGAXXXXXXDXXXXXXXXXXXXNXXXNXXXXXXXXXXXXXXDXXXXXXXXXXXXXXXXXXXXXXXXXXXXXXXXXXXXXXXXXXXDXXXXDPPXFXXXXXXXXXXXXXXXXXXXXXXXXXXXXXXXGXXXXXXXXXXXXXXXXXXXXXXXXXXXXXXXXXXXXXXXXXXXXDXXXXXXXXXXXYLXXXXXXXXXXXXXXXXXXXXXXXXXX

SEQ ID NO: 94731 - protein, 290 aa, artificial
  consensus sequence
  misc_feature (1)..(105): Xaa can be any naturally occurring amino acid
  misc_feature (114)..(115): Xaa can be any naturally occurring amino acid
  misc_feature (117)..(119): Xaa can be any naturally occurring amino acid
  misc_feature (124)..(124): Xaa can be any naturally occurring amino acid
  misc_feature (126)..(128): Xaa can be any naturally occurring amino acid
  misc_feature (130)..(130): Xaa can be any naturally occurring amino acid
  misc_feature (136)..(136): Xaa can be any naturally occurring amino acid
  misc_feature (141)..(141): Xaa can be any naturally occurring amino acid
  misc_feature (145)..(145): Xaa can be any naturally occurring amino acid
  misc_feature (147)..(147): Xaa can be any naturally occurring amino acid
  misc_feature (149)..(151): Xaa can be any naturally occurring amino acid
  misc_feature (153)..(171): Xaa can be any naturally occurring amino acid
  misc_feature (174)..(176): Xaa can be any naturally occurring amino acid
  misc_feature (179)..(180): Xaa can be any naturally occurring amino acid
  misc_feature (186)..(186): Xaa can be any naturally occurring amino acid
  misc_feature (188)..(188): Xaa can be any naturally occurring amino acid
  misc_feature (190)..(194): Xaa can be any naturally occurring amino acid
  misc_feature (197)..(197): Xaa can be any naturally occurring amino acid
  misc_feature (200)..(201): Xaa can be any naturally occurring amino acid
  misc_feature (204)..(205): Xaa can be any naturally occurring amino acid
  misc_feature (207)..(208): Xaa can be any naturally occurring amino acid
  misc_feature (210)..(210): Xaa can be any naturally occurring amino acid
  misc_feature (214)..(214): Xaa can be any naturally occurring amino acid
  misc_feature (217)..(218): Xaa can be any naturally occurring amino acid
  misc_feature (221)..(221): Xaa can be any naturally occurring amino acid
  misc_feature (225)..(225): Xaa can be any naturally occurring amino acid
  misc_feature (228)..(228): Xaa can be any naturally occurring amino acid
  misc_feature (232)..(235): Xaa can be any naturally occurring amino acid
  misc_feature (237)..(238): Xaa can be any naturally occurring amino acid
  misc_feature (240)..(240): Xaa can be any naturally occurring amino acid
  misc_feature (242)..(243): Xaa can be any naturally occurring amino acid
  misc_feature (246)..(265): Xaa can be any naturally occurring amino acid
  misc_feature (267)..(290): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMLKFLSKVXXEXXXLDPRXAXXXEXLAQCNXRKAKXSNPXCXVXXXRXXXXXXXXXXXXXXXXXXXPPXXXVTXXNGVEEXFXAXXXXXAQXIRXXILXXGXXLXTEQXFRXXGEXWPVXIPXEELXXXXPXXGXKXXKAXXXXXXXXXXXXXXXXXXXXKXXXXXXXXXXXXXXXXXXXXXXXX

SEQ ID NO: 94732 - protein, 916 aa, artificial
  consensus sequence
  misc_feature (1)..(127): Xaa can be any naturally occurring amino acid
  misc_feature (130)..(131): Xaa can be any naturally occurring amino acid
  misc_feature (133)..(134): Xaa can be any naturally occurring amino acid
  misc_feature (136)..(138): Xaa can be any naturally occurring amino acid
  misc_feature (141)..(151): Xaa can be any naturally occurring amino acid
  misc_feature (153)..(161): Xaa can be any naturally occurring amino acid
  misc_feature (163)..(164): Xaa can be any naturally occurring amino acid
  misc_feature (166)..(176): Xaa can be any naturally occurring amino acid
  misc_feature (178)..(190): Xaa can be any naturally occurring amino acid
  misc_feature (192)..(192): Xaa can be any naturally occurring amino acid
  misc_feature (194)..(194): Xaa can be any naturally occurring amino acid
  misc_feature (196)..(200): Xaa can be any naturally occurring amino acid
  misc_feature (202)..(202): Xaa can be any naturally occurring amino acid
  misc_feature (204)..(205): Xaa can be any naturally occurring amino acid
  misc_feature (207)..(210): Xaa can be any naturally occurring amino acid
  misc_feature (212)..(236): Xaa can be any naturally occurring amino acid
  misc_feature (238)..(239): Xaa can be any naturally occurring amino acid
  misc_feature (242)..(247): Xaa can be any naturally occurring amino acid
  misc_feature (249)..(249): Xaa can be any naturally occurring amino acid
  misc_feature (252)..(254): Xaa can be any naturally occurring amino acid
  misc_feature (256)..(268): Xaa can be any naturally occurring amino acid
  misc_feature (271)..(272): Xaa can be any naturally occurring amino acid
  misc_feature (274)..(280): Xaa can be any naturally occurring amino acid
  misc_feature (282)..(351): Xaa can be any naturally occurring amino acid
  misc_feature (354)..(354): Xaa can be any naturally occurring amino acid
  misc_feature (356)..(358): Xaa can be any naturally occurring amino acid
  misc_feature (361)..(363): Xaa can be any naturally occurring amino acid
  misc_feature (365)..(365): Xaa can be any naturally occurring amino acid
  misc_feature (367)..(367): Xaa can be any naturally occurring amino acid
  misc_feature (369)..(370): Xaa can be any naturally occurring amino acid
  misc_feature (372)..(399): Xaa can be any naturally occurring amino acid
  misc_feature (401)..(434): Xaa can be any naturally occurring amino acid
  misc_feature (437)..(441): Xaa can be any naturally occurring amino acid
  misc_feature (444)..(445): Xaa can be any naturally occurring amino acid
  misc_feature (447)..(447): Xaa can be any naturally occurring amino acid
  misc_feature (449)..(452): Xaa can be any naturally occurring amino acid
  misc_feature (454)..(455): Xaa can be any naturally occurring amino acid
  misc_feature (459)..(480): Xaa can be any naturally occurring amino acid
  misc_feature (482)..(482): Xaa can be any naturally occurring amino acid
  misc_feature (485)..(485): Xaa can be any naturally occurring amino acid
  misc_feature (489)..(489): Xaa can be any naturally occurring amino acid
  misc_feature (491)..(494): Xaa can be any naturally occurring amino acid
  misc_feature (496)..(498): Xaa can be any naturally occurring amino acid
  misc_feature (500)..(501): Xaa can be any naturally occurring amino acid
  misc_feature (503)..(511): Xaa can be any naturally occurring amino acid
  misc_feature (513)..(514): Xaa can be any naturally occurring amino acid
  misc_feature (516)..(518): Xaa can be any naturally occurring amino acid
  misc_feature (520)..(525): Xaa can be any naturally occurring amino acid
  misc_feature (527)..(916): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYCXXSXXMXXXNKXXXXXXXXXXXFXXXXXXXXXQXXVXXXXXXXXXXXGXXXXXXXXXXXXXKXWXPXXXXXVXMXXTXXXXLXXXXXXXXXXXXXXXXXXXXXXXXXTXXKNXXXXXXAXGEXXXFXXXXXXXXXXXXXLMXXSXXXXXXXDXXXXXXXXXXXXXXXXXXXXXXXXXXXXXXXXXXXXXXXXXXXXXXXXXXXXXXXXXXXXXXXXXXXXXXGYXWXXXNCXXXAXYXLXXRXXXXXXXXXXXXXXXXXXXXXXXXXXXXSXXXXXXXXXXXXXXXXXXXXXXXXXXXXXXXXXXSGXXXXXISXXSXWXXXXTXXTTYXXXXXXXXXXXXXXXXXXXXXXSXVGXLNKXPXXXXGXXXFXXPXXXXXXXXXIXXGXXXGXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 94733 - protein, 224 aa, artificial
  consensus sequence
  misc_feature (1)..(63): Xaa can be any naturally occurring amino acid
  misc_feature (66)..(67): Xaa can be any naturally occurring amino acid
  misc_feature (71)..(74): Xaa can be any naturally occurring amino acid
  misc_feature (82)..(83): Xaa can be any naturally occurring amino acid
  misc_feature (85)..(101): Xaa can be any naturally occurring amino acid
  misc_feature (110)..(110): Xaa can be any naturally occurring amino acid
  misc_feature (113)..(115): Xaa can be any naturally occurring amino acid
  misc_feature (118)..(120): Xaa can be any naturally occurring amino acid
  misc_feature (123)..(125): Xaa can be any naturally occurring amino acid
  misc_feature (131)..(132): Xaa can be any naturally occurring amino acid
  misc_feature (134)..(134): Xaa can be any naturally occurring amino acid
  misc_feature (136)..(138): Xaa can be any naturally occurring amino acid
  misc_feature (140)..(141): Xaa can be any naturally occurring amino acid
  misc_feature (145)..(145): Xaa can be any naturally occurring amino acid
  misc_feature (148)..(159): Xaa can be any naturally occurring amino acid
  misc_feature (161)..(163): Xaa can be any naturally occurring amino acid
  misc_feature (165)..(166): Xaa can be any naturally occurring amino acid
  misc_feature (168)..(170): Xaa can be any naturally occurring amino acid
  misc_feature (172)..(172): Xaa can be any naturally occurring amino acid
  misc_feature (174)..(174): Xaa can be any naturally occurring amino acid
  misc_feature (176)..(177): Xaa can be any naturally occurring amino acid
  misc_feature (179)..(179): Xaa can be any naturally occurring amino acid
  misc_feature (184)..(185): Xaa can be any naturally occurring amino acid
  misc_feature (188)..(224): Xaa can be any naturally occurring amino acid
XXXXXXXXXXXXXXXXXXXXXXXXXXXXXXXXXXXXXXXXXXXXXXXXXXXXXXXXXXXXXXXMSXXYSLXXXXLQHFMVLXXPXXXXXXXXXXXXXXXXXLVFDFQPRXPEXXXAAXXXLSXXXIPGVVXXRXLXXXPXXRCWXVGXXXXXXXXXXXXAXXXAXXFXXXWXTXLXXGXHDCRXXTNXXXXXXXXXXXXXXXXXXXXXXXXXXXXXXXXXXXXX

SEQ ID NO: 94734 - protein, 1759 aa, artificial
  consensus sequence
  misc_feature (1)..(1224): Xaa can be any naturally occurring amino acid
  misc_feature (1226)..(1273): Xaa can be any naturally occurring amino acid
  misc_feature (1277)..(1280): Xaa can be any naturally occurring amino acid
  misc_feature (1282)..(1283): Xaa can be any naturally occurring amino acid
  misc_feature (1285)..(1285): Xaa can be any naturally occurring amino acid
  misc_feature (1287)..(1288): Xaa can be any naturally occurring amino acid
  misc_feature (1290)..(1291): Xaa can be any naturally occurring amino acid
  misc_feature (1294)..(1295): Xaa can be any naturally occurring amino acid
  misc_feature (1297)..(1299): Xaa can be any naturally occurring amino acid
  misc_feature (1301)..(1302): Xaa can be any naturally occurring amino acid
  misc_feature (1304)..(1304): Xaa can be any naturally occurring amino acid
  misc_feature (1306)..(1306): Xaa can be any naturally occurring amino acid
  misc_feature (1308)..(1309): Xaa can be any naturally occurring amino acid
  misc_feature (1311)..(1311): Xaa can be any naturally occurring amino acid
  misc_feature (1315)..(1318): Xaa can be any naturally occurring amino acid
  misc_feature (1320)..(1320): Xaa can be any naturally occurring amino acid
  misc_feature (1322)..(1390): Xaa can be any naturally occurring amino acid
  misc_feature (1392)..(1394): Xaa can be any naturally occurring amino acid
  misc_feature (1397)..(1397): Xaa can be any naturally occurring amino acid
  misc_feature (1399)..(1399): Xaa can be any naturally occurring amino acid
  misc_feature (1401)..(1404): Xaa can be any naturally occurring amino acid
  misc_feature (1412)..(1412): Xaa can be any naturally occurring amino acid
  misc_feature (1414)..(1414): Xaa can be any naturally occurring amino acid
  misc_feature (1416)..(1461): Xaa can be any naturally occurring amino acid
  misc_feature (1466)..(1466): Xaa can be any naturally occurring amino acid
  misc_feature (1469)..(1469): Xaa can be any naturally occurring amino acid
  misc_feature (1471)..(1471): Xaa can be any naturally occurring amino acid
  misc_feature (1475)..(1478): Xaa can be any naturally occurring amino acid
  misc_feature (1481)..(1481): Xaa can be any naturally occurring amino acid
  misc_feature (1483)..(1483): Xaa can be any naturally occurring amino acid
  misc_feature (1485)..(1527): Xaa can be any naturally occurring amino acid
  misc_feature (1529)..(1618): Xaa can be any naturally occurring amino acid
  misc_feature (1620)..(1621): Xaa can be any naturally occurring amino acid
  misc_feature (1623)..(1623): Xaa can be any naturally occurring amino acid
  misc_feature (1626)..(1629): Xaa can be any naturally occurring amino acid
  misc_feature (1632)..(1632): Xaa can be any naturally occurring amino acid
  misc_feature (1634)..(1634): Xaa can be any naturally occurring amino acid
  misc_feature (1637)..(1640): Xaa can be any naturally occurring amino acid
  misc_feature (1642)..(1643): Xaa can be any naturally occurring amino acid
  misc_feature (1653)..(1653): Xaa can be any naturally occurring amino acid
  misc_feature (1655)..(1656): Xaa can be any naturally occurring amino acid
  misc_feature (1658)..(1658): Xaa can be any naturally occurring amino acid
  misc_feature (1660)..(1660): Xaa can be any naturally occurring amino acid
  misc_feature (1663)..(1663): Xaa can be any naturally occurring amino acid
  misc_feature (1665)..(1674): Xaa can be any naturally occurring amino acid
  misc_feature (1677)..(1678): Xaa can be any naturally occurring amino acid
  misc_feature (1681)..(1682): Xaa can be any naturally occurring amino acid
  misc_feature (1687)..(1688): Xaa can be any naturally occurring amino acid
  misc_feature (1690)..(1690): Xaa can be any naturally occurring amino acid
  misc_feature (1692)..(1692): Xaa can be any naturally occurring amino acid
  misc_feature (1695)..(1696): Xaa can be any naturally occurring amino acid
  misc_feature (1701)..(1701): Xaa can be any naturally occurring amino acid
  misc_feature (1705)..(1705): Xaa can be any naturally occurring amino acid
  misc_feature (1707)..(1707): Xaa can be any naturally occurring amino acid
  misc_feature (1709)..(1712): Xaa can be any naturally occurring amino acid
  misc_feature (1714)..(1714): Xaa can be any naturally occurring amino acid
  misc_feature (1717)..(1717): Xaa can be any naturally occurring amino acid
  misc_feature (1719)..(1721): Xaa can be any naturally occurring amino acid
  misc_feature (1723)..(1724): Xaa can be any naturally occurring amino acid
  misc_feature (1726)..(1727): Xaa can be any naturally occurring amino acid
  misc_feature (1731)..(1731): Xaa can be any naturally occurring amino acid
  misc_feature (1733)..(1735): Xaa can be any naturally occurring amino acid
  misc_feature (1740)..(1759): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXEPHXXXXWXXFXYXXDXXGDXXFXXXDXXNXLXDXXAXNPVXXXXGXDXXXXXXXXXXXXXXXXXXXXXXXXXXXXXXXXXXXXXXXXXXXXXXXXXXXXXXXXXXXXXXXXXXXXXIXXXWGXPXTXXXXHPIYFAKXLXKXXXXXXXXXXXXXXXXXXXXXXXXXXXXXXXXXXXXXXXXXXXXXXPSNGXSIXGXLRPXXXXEEXYXRXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXYXLEXXXXELXSXYGXXXXIXXQDFQDAEPDXLXXSXSXIIXRXXXXXXXXXXALXXLCXXKKGLXXEXAXLIXXDSLGXDVRXFXGXXXXTXRFXFXXXAXXEXXAEKXIXXXLFPRXXXXXXXXXXXXXXXXXXXX
